(12) United States Patent
Kinsella et al.

(10) Patent No.: US 11,104,737 B2
(45) Date of Patent: Aug. 31, 2021

(54) ACVR2A-SPECIFIC ANTIBODY AND METHOD OF TREATMENT OF MUSCLE ATROPHY

(71) Applicant: Rigel Pharmaceuticals, Inc., South San Francisco, CA (US)

(72) Inventors: Todd M. Kinsella, Redwood City, CA (US); Ramesh Bhatt, Belmont, CA (US); Kristen Baltgalvis, Millbrae, CA (US)

(73) Assignee: RIGEL PHARMACEUTICALS, INC., South San Francisco, CA (US)

( * ) Notice: Subject to any disclaimer, the term of this patent is extended or adjusted under 35 U.S.C. 154(b) by 0 days.

(21) Appl. No.: 16/488,082

(22) PCT Filed: Mar. 27, 2018

(86) PCT No.: PCT/US2018/024632
§ 371 (c)(1),
(2) Date: Aug. 22, 2019

(87) PCT Pub. No.: WO2018/183376
PCT Pub. Date: Oct. 4, 2018

(65) Prior Publication Data
US 2019/0382496 A1 Dec. 19, 2019

Related U.S. Application Data

(60) Provisional application No. 62/477,911, filed on Mar. 28, 2017.

(51) Int. Cl.
| | | |
|---|---|---|
| *C07K 16/28* | (2006.01) | |
| *A61K 39/395* | (2006.01) | |
| *A61P 21/06* | (2006.01) | |
| *A61K 47/61* | (2017.01) | |
| *A61K 47/54* | (2017.01) | |
| *A61K 47/60* | (2017.01) | |
| *C07K 14/71* | (2006.01) | |
| *C07K 14/475* | (2006.01) | |

(52) U.S. Cl.
CPC ...... *C07K 16/2863* (2013.01); *A61K 39/3955* (2013.01); *A61K 47/542* (2017.08); *A61K 47/543* (2017.08); *A61K 47/60* (2017.08); *A61K 47/61* (2017.08); *A61P 21/06* (2018.01); *C07K 14/475* (2013.01); *C07K 14/71* (2013.01); *C07K 2317/565* (2013.01); *C07K 2317/622* (2013.01); *C07K 2317/76* (2013.01); *C07K 2317/92* (2013.01)

(58) Field of Classification Search
CPC ............ C07K 16/2863; C07K 16/2866; A61K 39/3955; A61P 21/06
See application file for complete search history.

(56) References Cited

U.S. PATENT DOCUMENTS

| | | |
|---|---|---|
| 2003/0104569 A1 | 6/2003 | Oritani et al. |
| 2007/0202566 A1 | 8/2007 | Bornscheuer et al. |
| 2009/0074768 A1 | 3/2009 | Knopf et al. |
| 2012/0201827 A1 | 8/2012 | Elias et al. |
| 2014/0199317 A1 | 7/2014 | Seehra et al. |
| 2015/0152194 A1 | 6/2015 | Han et al. |
| 2016/0068601 A1 | 3/2016 | Brogdon et al. |

FOREIGN PATENT DOCUMENTS

WO   WO 2012/064771 A1   5/2012

OTHER PUBLICATIONS

Rudikoff et al (Proc Natl Acad Sci USA 1982 vol. 79 pp. 1979-1983).*
Ferrara et al (2015. mAbs. 7(1): 32-41).*
Lach-Trifilieff etal, 2014. Molecular and Cellular Biology. 34(4): 606-618).*
McCallum et al., "Antibody-antigen Interactions: Contact Analysis and Binding Site Topography", J. Mol. Biol., 1996, 262: 732-745.
Olsen et al., "Activin A inhibits BMP-signaling by binding ACVR2A and ACVR2B", Cell Communication and Signaling 2015, 13:27, DOI 10.1186/s12964-015-0104-z.
Burks et al., "In vitro scanning saturation mutagenesis of an antibody binding pocket", Proc. Natl. Acad. Sci., 1997, 94: 412-417.
Chen et al., "In vitro scanning saturation mutagenesis of all the specificity determining residues in an antibody binding site", Protein Engineering, 1999, 12(4): 349-356.

* cited by examiner

*Primary Examiner* — Zachary C Howard
(74) *Attorney, Agent, or Firm* — James S. Keddie; Bozicevic, Field & Francis LLP

(57) ABSTRACT

The present disclosure provides antibodies that specifically bind to and block signaling by ACVR2A, i.e., ACVR2A but not ACVR2B, as well as methods for using the same. The antibodies may be used for the treatment of a number of conditions associated with muscle atrophy, as well as other conditions.

17 Claims, No Drawings
Specification includes a Sequence Listing.

ACVR2A-SPECIFIC ANTIBODY AND METHOD OF TREATMENT OF MUSCLE ATROPHY

CROSS-REFERENCING

This application is a § 371 national phase of International Application No. PCT/US2018/024632, filed on Mar. 27, 2018, which claims the benefit of U.S. provisional application Ser. No. 62/477,911, filed on Mar. 28, 2017, which applications are incorporated herein in their entireties.

BACKGROUND

The activin receptor, type II A (ACVR2A) is a high affinity receptor for the activin proteins as well as other members of the TGF-beta superfamily. ACVR2A is generally thought to transduce signals that lead to the phosphorylation of one or more SMAD transcription factors, particularly SMADs 1, 2, 3 and 5. ACVR2A has been implicated in the regulation of a wide range of biological processes, including bone formation, muscle formation, red blood cell formation, tumor growth, immune function and the production of reproductive hormones.

There is a need for reagents, e.g., antibodies, that specifically bind to ACVR2A and inhibit ACVR2A signaling.

SUMMARY OF THE INVENTION

The present disclosure provides antibodies that specifically bind to and block signaling by ACVR2A, i.e., ACVR2A but not ACVR2B. The antibodies are useful in various treatment, diagnostic, and monitoring applications. In some embodiments, an antibody may comprise: (a) a variable domain comprising: i. heavy chain CDR1, CDR2 and CDR3 regions that are identical the heavy chain CDR1, CDR2 and CDR3 regions of an antibody selected from any of Tables 2A-2F; and ii. light chain CDR1, CDR2 and CDR3 regions that are identical the light chain CDR1, CDR2 and CDR3 regions of the antibody selected from any of Tables 2A-2F; or (b) a variant of said variable domain of (a) that is otherwise identical to said antibody variable domain except for up to 15 amino acid substitutions in said CDR regions.

In some embodiments, an antibody may comprise: (a) a heavy chain variable domain comprising a heavy chain framework, a CDR1 region, a CDR2 region, and a CDR3 region of sequence ARSATWHDTXLD (SEQ ID NO:6538) or a variant of ARSATWHDTXLD (SEQ ID NO:6538) that comprises up to three amino acid substitutions, and (b) a light chain variable domain comprising a light chain framework, a CDR1 region, a CDR2 region, and a CDR3 region.

Definitions

The terms "antibodies" and "immunoglobulin" include antibodies or immunoglobulins of any isotype, fragments of antibodies which retain specific binding to antigen, including, but not limited to, Fab, Fv, scFv, and Fd fragments, chimeric antibodies, humanized antibodies, single-chain antibodies, and fusion proteins comprising an antigen-binding portion of an antibody and a non-antibody protein. The antibodies may be detectably labeled, e.g., with a radioisotope, an enzyme which generates a detectable product, a fluorescent protein, and the like. The antibodies may be further conjugated to other moieties, such as members of specific binding pairs, e.g., biotin (member of biotin-avidin specific binding pair), and the like. The antibodies may also be bound to a solid support, including, but not limited to, polystyrene plates or beads, and the like. Also encompassed by the term are Fab', Fv, F(ab')$_2$, and or other antibody fragments that retain specific binding to antigen, and monoclonal antibodies. An antibody may be monovalent or bivalent.

"Antibody fragments" comprise a portion of an intact antibody, for example, the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 (1995)); single-chain antibody molecules; and multi-specific antibodies formed from antibody fragments. Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRS of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The "Fab" fragment also contains the constant domain of the light chain and the first constant domain (CH$_1$) of the heavy chain. Fab fragments differ from Fab' fragments by the addition of a few residues at the carboxyl terminus of the heavy chain CH$_1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. In some embodiments, the Fv polypeptide further comprises a polypeptide linker between the $V_H$ and $V_L$ domains, which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444-6448 (1993).

As used herein, the term "affinity" refers to the equilibrium constant for the reversible binding of two agents and is expressed as a dissociation constant (Kd). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more. As used herein, the term "avidity" refers to the resistance of a complex of two or more agents to dissociation after dilution. The terms "immunoreactive" and "preferentially binds" are used interchangeably herein with respect to antibodies and/or antigen-binding fragments.

The term "binding" refers to a direct association between two molecules, due to, for example, covalent, electrostatic, hydrophobic, and ionic and/or hydrogen-bond interactions, including interactions such as salt bridges and water bridges. An ACVR2A-specific antibody antibodies binds specifically to an epitope within a ACVR2A polypeptide. Non-specific binding would refer to binding with an affinity of less than about $10^{-7}$ M, e.g., binding with an affinity of $10^{-6}$ M, $10^{-5}$ M, $10^{-4}$ M, etc.

As used herein, the term "CDR" or "complementarity determining region" is intended to mean the non-contiguous antigen combining sites found within the variable region of both heavy and light chain polypeptides. CDRs have been described by Kabat et al., J. Biol. Chem. 252:6609-6616 (1977); Kabat et al., U.S. Dept. of Health and Human Services, "Sequences of proteins of immunological interest" (1991); by Chothia et al., J. Mol. Biol. 196:901-917 (1987); and MacCallum et al., J. Mol. Biol. 262:732-745 (1996), where the definitions include overlapping or subsets of amino acid residues when compared against each other. Nevertheless, application of either definition to refer to a CDR of an antibody or grafted antibodies or variants thereof is intended to be within the scope of the term as defined and used herein. The amino acid residues which encompass the CDRs as defined by each of the above cited references are set forth below in Table 1 as a comparison.

TABLE 1

CDR Definitions

|  | Kabat[1] | Chothia[2] | MacCallum[3] |
|---|---|---|---|
| $V_H$ CDR1 | 31-35 | 26-32 | 30-35 |
| $V_H$ CDR2 | 50-65 | 53-55 | 47-58 |
| $V_H$ CDR3 | 95-102 | 96-101 | 93-101 |
| $V_L$ CDR1 | 24-34 | 26-32 | 30-36 |
| $V_L$ CDR2 | 50-56 | 50-52 | 46-55 |
| $V_L$ CDR3 | 89-97 | 91-96 | 89-96 |

[1]Residue numbering follows the nomenclature of Kabat et al., supra
[2]Residue numbering follows the nomenclature of Chothia et al., supra
[3]Residue numbering follows the nomenclature of MacCallum et al., supra As used herein, the term "framework" when used in reference to an antibody variable region is intended to mean all amino acid residues outside the CDR regions within the variable region of an antibody. A variable region framework is generally a discontinuous amino acid sequence between about 100-120 amino acids in length but is intended to reference only those amino acids outside of the CDRs. As used herein, the term "framework region" is intended to mean each domain of the framework that is separated by the CDRs.

An "isolated" antibody is one that has been identified and separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In some embodiments, the antibody will be purified (1) to greater than 90%, greater than 95%, or greater than 98%, by weight of antibody as determined by the Lowry method, for example, more than 99% by weight, (2) to a degree sufficient to obtain at least 15 residues of N-terminal or internal amino acid sequence by use of a spinning cup sequenator, or (3) to homogeneity by sodium dodecyl sulfate-polyacrylamide gel electrophoresis (SDS-PAGE) under reducing or nonreducing conditions using Coomassie blue or silver stain. Isolated antibody includes the antibody in situ within recombinant cells since at least one component of the antibody's natural environment will not be present. In some instances, isolated antibody will be prepared by at least one purification step.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (rats, mice), non-human primates, humans, canines, felines, ungulates (e.g., equines, bovines, ovines, porcines, caprines), etc.

A "therapeutically effective amount" or "efficacious amount" refers to the amount of an ACVR2A-specific antibody that, when administered to a mammal or other subject for treating a disease, is sufficient to effect such treatment for the disease. The "therapeutically effective amount" will vary depending on the ACVR2A-specific antibody, the disease and its severity and the age, weight, etc., of the subject to be treated.

A "biological sample" encompasses a variety of sample types obtained from an individual and can be used in a diagnostic or monitoring assay. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents, solubilization, or enrichment for certain components, such as polynucleotides. The term "biological sample" encompasses a clinical sample, and also includes cells in culture, cell supernatants, cell lysates, serum, plasma, biological fluid, and tissue samples.

The present disclosure may make use of consensus sequences. If an amino acid sequence is indicated as being "of sequence Y", where Y is a consensus sequence, the amino acid sequence falls within the consensus sequence. In a consensus sequence, the amino acid "X" can be any amino acid.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "an antibody" includes a plurality of such antibodies and reference to "the ACVR2A-specific antibody" includes reference to one or more ACVR2A-specific antibodies and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides antibodies that specifically bind to and block signaling by ACVR2A, i.e., ACVR2A but not ACVR2B. In some embodiments, the antibody may comprise (a) a variable domain comprising: i. heavy chain CDR1, CDR2 and CDR3 regions that are identical the heavy chain CDR1, CDR2 and CDR3 regions of an antibody selected from any of Tables 2A-2F; and ii. light chain CDR1, CDR2 and CDR3 regions that are identical the light chain CDR1, CDR2 and CDR3 regions of the antibody selected from any of Tables 2A-2F; or (b) a variant of the variable domain of (a) that is otherwise identical to the antibody variable domain of (a) except for up to 15 amino acid substitutions in the CDR regions, e.g., up to 15, up to 14, up to 13, up to 12, up to 11, up to 10, up to 9, up to 8, up to 7, up to 6, up to 5, up to 4, up to 3, up to 2 amino acid substitutions in the CDR regions.

In some embodiments, the antibody may comprise: a heavy chain variable domain comprising: a heavy chain framework, a CDR1 region, a CDR2 region, and a CDR3 region of sequence AxxAxWHDTxLD; and a light chain variable domain comprising: a light chain framework, a CDR1 region, a CDR2 region, and a CDR3 region. For example, in some embodiments, the heavy chain variable domain of the antibody may comprise a CDR3 region of sequence ARSATWHDTxLD (SEQ ID NO: 6538) (e.g., ARAANWHDTA/HLD (SEQ ID NO: 6539)), ARAATWHDTxLD (SEQ ID NO: 6540) (e.g., ARAATWHDTH/ALD (SEQ ID NO: 6541)), ARGANWHDTxLD (SEQ ID NO: 6542) (e.g., ARGANWHDTA/HLD (SEQ ID NO: 6543)), ARGATWHDTxLD (SEQ ID NO: 6544) (e.g., ARGATWHDTH/ALD (SEQ ID NO: 6545)), ARSANWHDTxLD (SEQ ID NO: 6546) (e.g., AR/KSANWHDTA/HLD (SEQ ID NO: 6547)) or ARSATWHDTxLD (SEQ ID NO: 6548) (e.g., ARSATWHDTH/ALD (SEQ ID NO: 6549)).

As will be shown below, there is considerable diversity in the heavy chain CDR1, heavy chain CDR2, light chain CDR1, light chain CDR2 and light chain CDR3 regions in the present antibodies. Therefore, consistent with Barrios et al (Mol. Recognit. 2004 17: 332-8) and Bowers et al (J. Biol. Chem. 2013 288: 7688-96) the heavy chain CDR3 is believed primarily responsible for antigen binding in the present antibody.

In some embodiments, the antibody may comprise a heavy chain variable domain comprising: i. a CDR1 region that has a sequence of D/SS/DYG/SMH/N (SEQ ID NO: 6550), ii. a CDR2 region that has a sequence of WVA/SS/G/NINYNG/SGYT/KS/G (SEQ ID NO: 6551), and iii. a CDR3 region that has a sequence of ARAANWHDTA/HLD (SEQ ID NO: 6552); and a light chain variable domain comprising: i. a CDR1 region that has a sequence of XXYL/VNWY (SEQ ID NO: 6553) (e.g., L/V/I/SS/T/RYL/VNWY (SEQ ID NO: 6554)), ii. a CDR2 region that has a sequence of LV/LIYXXXS/NR/LX (SEQ ID NO: 6555) (e.g., LV/LIYA/Y/VA/V/TT/S/NS/NR/LA/H/Q/P (SEQ ID NO: 6556)), and iii. a CDR3 region that has a sequence of QQ/HSY/DXXPL (SEQ ID NO: 6557) (e.g., QQ/HSY/DD/E/S/NL/N/S/TPL (SEQ ID NO: 6558)).

In some embodiments, the antibody may comprise a heavy chain variable domain comprising: i. a CDR1 region that has a sequence of D/SS/DYG/SMH/N (SEQ ID NO: 6550), ii. a CDR2 region that has a sequence of WVA/SS/G/NINYNG/SGYT/KS/G (SEQ ID NO: 6551), and iii. a CDR3 region that has a sequence of ARAATWHDTH/ALD (SEQ ID NO: 6559); and a light chain variable domain comprising: i. a CDR1 region that has a sequence of XS/TYL/VNWY (SEQ ID NO: 6560) (e.g., L/V/I/SS/TYL/VNWY (SEQ ID NO: 6561)), ii. a CDR2 region that has a sequence of LL/VIYA/YXXS/NR/LX (SEQ ID NO: 6562) (e.g., LL/VIYA/YA/T/VT/S/NS/NR/LA/P/Q (SEQ ID NO: 6563)), and iii. a CDR3 region that has a sequence of QQSY/D/NXXPL (SEQ ID NO: 6564) (e.g., QQSY/D/ND/E/S/NL/S/T/NPL (SEQ ID NO: 6565)).

In some embodiments, the antibody may comprise a heavy chain variable domain comprising: i. a CDR1 region that has a sequence of S/DS/DYS/GMN/H (SEQ ID NO: 6566), ii. a CDR2 region that has a sequence of WVS/AG/S/NINYNG/SGYT/KS/G (SEQ ID NO: 6567), and iii. a CDR3 region that has a sequence of ARGANWHDTA/HLD (SEQ ID NO: 6543); and a light chain variable domain comprising: i. a CDR1 region that has a sequence of XS/TYL/VNWY (SEQ ID NO: 6568) (e.g., L/V/S/IS/TYL/VNWY (SEQ ID NO: 6569)), ii. a CDR2 region that has a sequence of LL/VIYAXT/SSR/LX (SEQ ID NO: 6570) (e.g., LL/VIYAA/V/TT/SSR/LA/H/Q (SEQ ID NO: 6571)), and iii. a CDR3 region that has a sequence of QQSY/DXXPL (SEQ ID NO: 6572) (e.g., QQSY/DD/E/S/NS/T/N/LPL (SEQ ID NO: 6573)).

In some embodiments, the antibody may comprise a heavy chain variable domain comprising: i. a CDR1 region that has a sequence of S/DS/DYS/GMN/H (SEQ ID NO: 6574), ii. a CDR2 region that has a sequence of WVA/SG/N/SINYNG/SGYT/KS/G (SEQ ID NO: 6575), and iii. a CDR3 region that has a sequence of ARGATWHDTH/ALD (SEQ ID NO: 6544); and a light chain variable domain comprising: i. a CDR1 region that has a sequence of XS/TYL/VNWY (SEQ ID NO: 6568) (e.g., L/I/V/SS/TYL/VNWY (SEQ ID NO: 6576)), ii. a CDR2 region that has a sequence of LL/VIYAXT/SSR/LX (SEQ ID NO: 6570) (e.g., LL/VIYAA/V/TT/SSR/LA/H/Q (SEQ ID NO: 6571)), and iii. a CDR3 region that has a sequence of QQSY/DXXPL (SEQ ID NO: 6572) (e.g., QQSY/DD/E/S/NT/S/N/LPL (SEQ ID NO: 6577)).

In some embodiments, the antibody may comprise a heavy chain variable domain comprising: i. a CDR1 region that has a sequence of S/DS/DYG/SMN/H (SEQ ID NO: 6578), ii. a CDR2 region that has a sequence of WVS/AG/N/SINYNG/SGYT/KS/G (SEQ ID NO: 6579), and iii. a CDR3 region that has a sequence of AR/KSANWHDTA/HLD (SEQ ID NO: 6580); and a light chain variable domain comprising: i. a CDR1 region that has a sequence of XS/TYL/VNWY (SEQ ID NO: 6568) (e.g., L/V/I/SS/TYL/VNWY (SEQ ID NO: 6561)), ii. a CDR2 region that has a sequence of LL/VIYA/YXT/SS/NR/LX (SEQ ID NO: 6581) (e.g., LL/VIYA/YA/V/TT/SS/NR/LA/H/Q (SEQ ID NO: 6582)), and iii. a CDR3 region that has a sequence of QQSY/DXXPL (SEQ ID NO: 6572) (e.g., QQSY/DD/E/N/S S/T/L/NPL (SEQ ID NO: 6583)).

In some embodiments, the antibody may comprise a heavy chain variable domain comprising: i. a CDR1 region that has a sequence of D/SS/DYS/GMN/H (SEQ ID NO: 6584), ii. a CDR2 region that has a sequence of WVA/SG/N/SINYNG/SGYT/KS/G (SEQ ID NO: 6585), and iii. a CDR3 region that has a sequence of ARSATWHDTH/ALD (SEQ ID NO: 6586); and a light chain variable domain comprising: i. a CDR1 region that has a sequence of XXYL/VNWY (SEQ ID NO: 6587) (e.g., L/V/I/SS/T/RYL/VNWY (SEQ ID NO: 6588)), ii. a CDR2 region that has a sequence of LL/VIYA/YXT/SS/NR/LX (SEQ ID NO: 6589) (e.g., LL/VIYA/YA/V/TT/SS/NR/LA/H/Q (SEQ ID NO: 6590)), and iii. a CDR3 region that has a sequence of QQSY/DXXPL (SEQ ID NO: 6572) (e.g., QQSY/DD/E/S/NL/N/T/SPL (SEQ ID NO: 6591)).

In some embodiments, the antibody may comprise: a heavy chain variable domain comprising an amino acid sequence that is at least 80% identical to (e.g., at least 90%, at least 95%, at least 98%, at least 99%, or 100% identical to) the amino acid sequence of the heavy chain variable domain of an antibody selected from any of Tables 2A-2F; and a light chain variable domain comprising an amino acid sequence that is at least 80% identical to (e.g., at least 90%, at least 95%, at least 98%, at least 99%, or 100% identical to) the light chain variable domain of the antibody selected from any of Tables 2A-2F.

Tables 2A-2F provides the amino acid sequences of the heavy and light variable domains of some examples of the present antibody.

TABLE 2A

Group I Antibody Sequences

| Ab | VH sequence | VL sequence |
|---|---|---|
| 365_B04 | EVQLLESGGGLVQPGGSLRLSCAASGFTFSSY GMHWVRQAPGKGLEWVASINYNSGYTSYADSV KGRFTISRDNSKNTLYLQMNSLRAEDTAVYYC ARAANWHDTALDYWGQGTLVTVSS (SEQ ID NO: 1) | DIQMTQSPSSLSASVGDRVTITCRASQSILTYLNWYQQK PGKAPKLLIYAATSRHSGVPSRFSGSGSGTDFTLTISSL QPEDFATYYCQQSDESPLTFGGGTKVEIK (SEQ ID NO: 58) |
| 365_B10 | EVQLLESGGGLVQPGGSLRLSCAASGFTFDDY SMHWVRQAPGKGLEWVASINYNSGYKGYADSV KGRFTISRDNSKNTLYLQMNSLRAEDTAVYYC ARAANWHDTALDYWGQGTLVTVSS (SEQ ID NO: 2) | DIQMTQSPSSLSASVGDRVTITCRASQSILRYLNWYQQK PGKAPKLLIYAATSRASGVPSRFSGSGSGTDFTLTISSL QPEDFATYYCQQSDNLPLTFGGGTKVEIK (SEQ ID NO: 59) |
| 365_C03 | EVQLLESGGGLVQPGGSLRLSCAASGFTFSSY GMHWVRQAPGKGLEWVAGINYNSGYKGYADSV KGRFTISRDNSKNTLYLQMNSLRAEDTAVYYC ARAANWHDTHLDYWGQGTLVTVSS (SEQ ID NO: 3) | DIQMTQSPSSLSASVGDRVTITCRASQSILTYVNWYQQK PGKAPKLVIYATTSLASGVPSRFSGSGSGTDFTLTISSL QPEDFATYYCQQSYNTPLTFGGGTKVEIK (SEQ ID NO: 60) |
| 365_C06 | EVQLLESGGGLVQPGGSLRLSCAASGFTFSDY GMHWVRQAPGKGLEWVSGINYNGGYTSYADSV KGRFTISRDNSKNTLYLQMNSLRAEDTAVYYC ARAANWHDTALDYWGQGTLVTVSS (SEQ ID NO: 4) | DIQMTQSPSSLSASVGDRVTITCRASQSISTYVNWYQQK PGKAPKLLIYAVTSLASGVPSRFSGSGSGTDFTLTISSL QPEDFATYYCQQSYDNPLTFGGGTKVEIK (SEQ ID NO: 61) |
| 365_D04 | EVQLLESGGGLVQPGGSLRLSCAASGFTFSDY GMHWVRQAPGKGLEWVAGINYNGGYKSYADSV KGRFTISRDNSKNTLYLQMNSLRAEDTAVYYC ARAANWHDTALDYWGQGTLVTVSS (SEQ ID NO: 5) | DIQMTQSPSSLSASVGDRVTITCRASQSISSYLNWYQQK PGKAPKLVIYAVTSRASGVPSRFSGSGSGTDFTLTISSL QPEDFATYYCQQSYDLPLTFGGGTKVEIK (SEQ ID NO: 62) |

TABLE 2A-continued

Group I Antibody Sequences

| Ab | VH sequence | VL sequence |
|---|---|---|
| 365_E04 | EVQLLESGGGLVQPGGSLRLSCAASGFTFDSYGMHWVRQAPGKGLEWVASINYNGGYKSYADSVKGRFTISRDNSKNTLYLQMNSLRAEDTAVYYCARAANWHDTALDYWGQGTLVTVSS (SEQ ID NO: 6) | DIQMTQSPSSLSASVGDRVTITCRASQSILSYVNWYQQKPGKAPKLLIYAATSLASGVPSRFSGSGSGTDFTLTISSLQPEDFATYYCQQSYELPLTFGGGTKVEIK (SEQ ID NO: 63) |
| 365_F11 | EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARAANWHDTHLDYWGQGTLVTVSS (SEQ ID NO: 7) | DIQMTQSPSSLSASVGDRVTITCRASQSIISYVNWYQQKPGKAPKLLIYAATSRASGVPSRFSGSGSGTDFTLTISSLQPEDFATYYCQQSYNTPLTFGGGTKVEIK (SEQ ID NO: 64) |
| 365_G07 | EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAANWHDTALDYWGQGTLVTVSS (SEQ ID NO: 8) | DIQMTQSPSSLSASVGDRVTITCRASQSIVSYLNWYQQKPGKAPKLLIYAATSRASGVPSRFSGSGSGTDFTLTISSLQPEDFATYYCQQSYDNPLTFGGGTKVEIK (SEQ ID NO: 65) |
| 365_H08 | EVQLLESGGGLVQPGGSLRLSCAASGFTFSSYGMHWVRQAPGKGLEWVASINYNGGYKSYADSVKGRFTISRDNSKNTLYLQMNSLRAEDTAVYYCARAANWHDTALDYWGQGTLVTVSS (SEQ ID NO: 9) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 66) |
| 366_A02 | EVQLLESGGGLVQPGGSLRLSCAASGFTFDSYGMNWVRQAPGKGLEWVASINYNSGYKGYADSVKGRFTISRDNSKNTLYLQMNSLRAEDTAVYYCARAANWHDTHLDYWGQGTLVTVSS (SEQ ID NO: 10) | DIQMTQSPSSLSASVGDRVTITCRASQSIVSYVNWYQQKPGKAPKLLIYAATSRASGVPSRFSGSGSGTDFTLTISSLQPEDFATYYCQQSYDLPLTFGGGTKVEIK (SEQ ID NO: 67) |
| 366_A04 | EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARAANWHDTALDYWGQGTLVTVSS (SEQ ID NO: 11) | DIQMTQSPSSLSASVGDRVTITCRASQSILTYLNWYQQKPGKAPKLVIYAATSLASGVPSRFSGSGSGTDFTLTISSLQPEDFATYYCQQSDDSPLTFGGGTKVEIK (SEQ ID NO: 68) |
| 366_D01 | EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARAANWHDTHLDYWGQGTLVTVSS (SEQ ID NO: 12) | DIQMTQSPSSLSASVGDRVTITCRASQSILTYVNWYQQKPGKAPKLLIYAATSRASGVPSRFSGSGSGTDFTLTISSLQPEDFATYYCQQSYENPLTFGGGTKVEIK (SEQ ID NO: 69) |
| 366_D03 | EVQLLESGGGLVQPGGSLRLSCAASGFTFDSYGMHWVRQAPGKGLEWVSSINYNGGYTGYADSVKGRFTISRDNSKNTLYLQMNSLRAEDTAVYYCARAANWHDTHLDYWGQGTLVTVSS (SEQ ID NO: 13) | DIQMTQSPSSLSASVGDRVTITCRASQSILSYVNWYQQKPGKAPKLLIYAATSRASGVPSRFSGSGSGTDFTLTISSLQPEDFATYYCQQSYDLPLTFGGGTKVEIK (SEQ ID NO: 70) |
| 366_F10 | EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARAANWHDTHLDYWGQGTLVTVSS (SEQ ID NO: 14) | DIQMTQSPSSLSASVGDRVTITCRASQSIVSYLNWYQQKPGKAPKLVIYAATSRASGVPSRFSGSGSGTDFTLTISSLQPEDFATYYCQQSYDTPLTFGGGTKVEIK (SEQ ID NO: 71) |
| 366_G06 | EVQLLESGGGLVQPGGSLRLSCAASGFTFSSYGMHWVRQAPGKGLEWVASINYNGGYTGYADSVKGRFTISRDNSKNTLYLQMNSLRAEDTAVYYCARAANWHDTHLDYWGQGTLVTVSS (SEQ ID NO: 15) | DIQMTQSPSSLSASVGDRVTITCRASQSIVSYVNWYQQKPGKAPKLVIYAATSRASGVPSRFSGSGSGTDFTLTISSLQPEDFATYYCQQSYDNPLTFGGGTKVEIK (SEQ ID NO: 72) |
| 367_B09 | EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTALDYWGQGTLVTVSS (SEQ ID NO: 16) | DIQMTQSPSSLSASVGDRVTITCRASQSILSYVNWYQQKPGKAPKLVIYAATSRASGVPSRFSGSGSGTDFTLTISSLQPEDFATYYCQQSYENPLTFGGGTKVEIK (SEQ ID NO: 73) |
| 367_B11 | EVQLLESGGGLVQPGGSLRLSCAASGFTFSDYSMHWVRQAPGKGLEWVANINYNSGYTSYADSVKGRFTISRDNSKNTLYLQMNSLRAEDTAVYYCARAANWHDTALDYWGQGTLVTVSS (SEQ ID NO: 17) | DIQMTQSPSSLSASVGDRVTITCRASQSILSYLNWYQQKPGKAPKLVIYAATSRASGVPSRFSGSGSGTDFTLTISSLQPEDFATYYCQQSYSTPLTFGGGTKVEIK (SEQ ID NO: 74) |

TABLE 2A-continued

Group I Antibody Sequences

| Ab | VH sequence | VL sequence |
|---|---|---|
| 367_C09 | EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTHLDYWGQGTLVTVSS (SEQ ID NO: 18) | DIQMTQSPSSLSASVGDRVTITCRASQSILSYVNWYQQKPGKAPKLVIYAATSRHSGVPSRFSGSGSGTDFTLTISSLQPEDFATYYCQQSYNTPLTFGGGTKVEIK (SEQ ID NO: 75) |
| 367_D11 | EVQLLESGGGLVQPGGSLRLSCAASGFTFDSYGMHWVRQAPGKGLEWVSINYNGGYKSYADSVKGRFTISRDNSKNTLYLQMNSLRAEDTAVYYCARAANWHDTALDYWGQGTLVTVSS (SEQ ID NO: 19) | DIQMTQSPSSLSASVGDRVTITCRASQSIISYLNWYQQKPGKAPKLLIYAATSRASGVPSRFSGSGSGTDFTLTISSLQPEDFATYYCQQSYDSPLTFGGGTKVEIK (SEQ ID NO: 76) |
| 367_F06 | EVQLLESGGGLVQPGGSLRLSCAASGFTFSSYGMNWVRQAPGKGLEWVSSINYNSGYTSYADSVKGRFTISRDNSKNTLYLQMNSLRAEDTAVYYCARAANWHDTALDYWGQGTLVTVSS (SEQ ID NO: 20) | DIQMTQSPSSLSASVGDRVTITCRASQSISSYVNWYQQKPGKAPKLLIYAVTSRASGVPSRFSGSGSGTDFTLTISSLQPEDFATYYCQQSYDSPLTFGGGTKVEIK (SEQ ID NO: 77) |
| 367_H01 | EVQLLESGGGLVQPGGSLRLSCAASGFTFDSYGMHWVRQAPGKGLEWVSINYNGGYKSYADSVKGRFTISRDNSKNTLYLQMNSLRAEDTAVYYCARAANWHDTALDYWGQGTLVTVSS (SEQ ID NO: 21) | DIQMTQSPSSLSASVGDRVTITCRASQSILTYLNWYQQKPGKAPKLVIYAATSRASGVPSRFSGSGSGTDFTLTISSLQPEDFATYYCQQSYDNPLTFGGGTKVEIK (SEQ ID NO: 78) |
| 368_A02 | EVQLLESGGGLVQPGGSLRLSCAASGFTFDSYGMNWVRQAPGKGLEWVAGINYNGGYKSYADSVKGRFTISRDNSKNTLYLQMNSLRAEDTAVYYCARAANWHDTHLDYWGQGTLVTVSS (SEQ ID NO: 22) | DIQMTQSPSSLSASVGDRVTITCRASQSIISYVNWYQQKPGKAPKLVIYAATSRASGVPSRFSGSGSGTDFTLTISSLQPEDFATYYCQQSYDTPLTFGGGTKVEIK (SEQ ID NO: 79) |
| 368_A06 | EVQLLESGGGLVQPGGSLRLSCAASGFTFDSYSMHWVRQAPGKGLEWVAGINYNSGYKGYADSVKGRFTISRDNSKNTLYLQMNSLRAEDTAVYYCARAANWHDTHLDYWGQGTLVTVSS (SEQ ID NO: 23) | DIQMTQSPSSLSASVGDRVTITCRASQSILSYVNWYQQKPGKAPKLLIYAATSRHSGVPSRFSGSGSGTDFTLTISSLQPEDFATYYCQQSYNSPLTFGGGTKVEIK (SEQ ID NO: 80) |
| 368_A12 | EVQLLESGGGLVQPGGSLRLSCAASGFTFDSYSMHWVRQAPGKGLEWVSSINYNSGYKGYADSVKGRFTISRDNSKNTLYLQMNSLRAEDTAVYYCARAANWHDTALDYWGQGTLVTVSS (SEQ ID NO: 24) | DIQMTQSPSSLSASVGDRVTITCRASQSILTYLNWYQQKPGKAPKLVIYAATSRASGVPSRFSGSGSGTDFTLTISSLQPEDFATYYCQQSYDSPLTFGGGTKVEIK (SEQ ID NO: 81) |
| 368_B03 | EVQLLESGGGLVQPGGSLRLSCAASGFTFDDYGMNWVRQAPGKGLEWVSGINYNGGYTSYADSVKGRFTISRDNSKNTLYLQMNSLRAEDTAVYYCARAANWHDTALDYWGQGTLVTVSS (SEQ ID NO: 25) | DIQMTQSPSSLSASVGDRVTITCRASQSILTYLNWYQQKPGKAPKLVIYAATSLASGVPSRFSGSGSGTDFTLTISSLQPEDFATYYCQHSYENPLTFGGGTKVEIK (SEQ ID NO: 82) |
| 368_B08 | EVQLLESGGGLVQPGGSLRLSCAASGFTFDSYGMNWVRQAPGKGLEWVSSINYNGGYTSYADSVKGRFTISRDNSKNTLYLQMNSLRAEDTAVYYCARAANWHDTHLDYWGQGTLVTVSS (SEQ ID NO: 26) | DIQMTQSPSSLSASVGDRVTITCRASQSILTYVNWYQQKPGKAPKLVIYAATSRASGVPSRFSGSGSGTDFTLTISSLQPEDFATYYCQQSYENPLTFGGGTKVEIK (SEQ ID NO: 83) |
| 368_B10 | EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTALDYWGQGTLVTVSS (SEQ ID NO: 27) | DIQMTQSPSSLSASVGDRVTITCRASQSILTYLNWYQQKPGKAPKLVIYAATSRASGVPSRFSGSGSGTDFTLTISSLQPEDFATYYCQQSDELPLTFGGGTKVEIK (SEQ ID NO: 84) |
| 368_B11 | EVQLLESGGGLVQPGGSLRLSCAASGFTFDSYGMHWVRQAPGKGLEWVSGINYNGGYKSYADSVKGRFTISRDNSKNTLYLQMNSLRAEDTAVYYCARAANWHDTHLDYWGQGTLVTVSS (SEQ ID NO: 28) | DIQMTQSPSSLSASVGDRVTITCRASQSILSYLNWYQQKPGKAPKLLIYAASSLQSGVPSRFSGSGSGTDFTLTISSLQPEDFATYYCQQSYDSPLTFGGGTKVEIK (SEQ ID NO: 85) |
| 368_C09 | EVQLLESGGGLVQPGGSLRLSCAASGFTFSSYSMHWVRQAPGKGLEWVSNINYNGGYTGYADSVKGRFTISRDNSKNTLYLQMNSLRAEDTAVYYCARAANWHDTHLDYWGQGTLVTVSS (SEQ ID NO: 29) | DIQMTQSPSSLSASVGDRVTITCRASQSILTYVNWYQQKPGKAPKLLIYAATSLASGVPSRFSGSGSGTDFTLTISSLQPEDFATYYCQQSYDLPLTFGGGTKVEIK (SEQ ID NO: 86) |

TABLE 2A-continued

Group I Antibody Sequences

| Ab | VH sequence | VL sequence |
|---|---|---|
| 368_D09 | EVQLLESGGGLVQPGGSLRLSCAASGFTFDSY GMHWVRQAPGKGLEWVAGINYNSGYKSYADSV KGRFTISRDNSKNTLYLQMNSLRAEDTAVYYC ARAANWHDTHLDYWGQGTLVTVSS (SEQ ID NO: 30) | DIQMTQSPSSLSASVGDRVTITCRASQSIVSYVNWYQQK PGKAPKLLIYAATSLASGVPSRFSGSGSGTDFTLTISSL QPEDFATYYCQQSYDNPLTFGGGTKVEIK (SEQ ID NO: 87) |
| 368_F02 | EVQLLESGGGLVQPGGSLRLSCAASGFTFSSY GMNWVRQAPGKGLEWVASINYNSGYTSYADSV KGRFTISRDNSKNTLYLQMNSLRAEDTAVYYC ARAANWHDTHLDYWGQGTLVTVSS (SEQ ID NO: 31) | DIQMTQSPSSLSASVGDRVTITCRASQSILSYLNWYQQK PGKAPKLLIYAASSLQSGVPSRFSGSGSGTDFTLTISSL QPEDFATYYCQQSYSLPLTFGGGTKVEIK (SEQ ID NO: 88) |
| 368_F10 | EVQLLESGGGLVQPGGSLRLSCAASGFTFSSY GMNWVRQAPGKGLEWVAGINYNSGYTSYADSV KGRFTISRDNSKNTLYLQMNSLRAEDTAVYYC ARAANWHDTHLDYWGQGTLVTVSS (SEQ ID NO: 32) | DIQMTQSPSSLSASVGDRVTITCRASQSIVSYVNWYQQK PGKAPKLLIYAATSRASGVPSRFSGSGSGTDFTLTISSL QPEDFATYYCQQSYDTPLTFGGGTKVEIK (SEQ ID NO: 89) |
| 369_B03 | EVQLLESGGGLVQPGGSLRLSCAASGFTFSSY GMHWVRQAPGKGLEWVAGINYNGGYTSYADSV KGRFTISRDNSKNTLYLQMNSLRAEDTAVYYC ARAANWHDTALDYWGQGTLVTVSS (SEQ ID NO: 33) | DIQMTQSPSSLSASVGDRVTITCRASQSILTYVNWYQQK PGKAPKLVIYAATSLASGVPSRFSGSGSGTDFTLTISSL QPEDFATYYCQQSYELPLTFGGGTKVEIK (SEQ ID NO: 90) |
| 369_G10 | EVQLLESGGGLVQPGGSLRLSCAASGFTFSSY GMNWVRQAPGKGLEWVASINYNGGYTSYADSV KGRFTISRDNSKNTLYLQMNSLRAEDTAVYYC ARAANWHDTALDYWGQGTLVTVSS (SEQ ID NO: 34) | DIQMTQSPSSLSASVGDRVTITCRASQSILSYLNWYQQK PGKAPKLVIYAATSRASGVPSRFSGSGSGTDFTLTISSL QPEDFATYYCQQSYDSPLTFGGGTKVEIK (SEQ ID NO: 91) |
| 369_H03 | EVQLLESGGGLVQPGGSLRLSCAASGFTFSSY SMHWVRQAPGKGLEWVASINYNSGYKSYADSV KGRFTISRDNSKNTLYLQMNSLRAEDTAVYYC ARAANWHDTALDYWGQGTLVTVSS (SEQ ID NO: 35) | DIQMTQSPSSLSASVGDRVTITCRASQSIVSYLNWYQQK PGKAPKLLIYATTSRASGVPSRFSGSGSGTDFTLTISSL QPEDFATYYCQQSYDTPLTFGGGTKVEIK (SEQ ID NO: 92) |
| 370_B01 | EVQLLESGGGLVQPGGSLRLSCAASGFTFDDY GMHWVRQAPGKGLEWVSGINYNGGYKSYADSV KGRFTISRDNSKNTLYLQMNSLRAEDTAVYYC ARAANWHDTALDYWGQGTLVTVSS (SEQ ID NO: 36) | DIQMTQSPSSLSASVGDRVTITCRASQSILSYVNWYQQK PGKAPKLLIYVASSRASGVPSRFSGSGSGTDFTLTISSL QPEDFATYYCQQSYSLPLTFGGGTKVEIK (SEQ ID NO: 93) |
| 370_D06 | EVQLLESGGGLVQPGGSLRLSCAASGFTFSSY GMNWVRQAPGKGLEWVASINYNGGYTSYADSV KGRFTISRDNSKNTLYLQMNSLRAEDTAVYYC ARAANWHDTHLDYWGQGTLVTVSS (SEQ ID NO: 37) | DIQMTQSPSSLSASVGDRVTITCRASQSIISYLNWYQQK PGKAPKLVIYAATSLASGVPSRFSGSGSGTDFTLTISSL QPEDFATYYCQQSYSSPLTFGGGTKVEIK (SEQ ID NO: 94) |
| 370_G04 | EVQLLESGGGLVQPGGSLRLSCAASGFTFSSY GMHWVRQAPGKGLEWVSGINYNGGYTGYADSV KGRFTISRDNSKNTLYLQMNSLRAEDTAVYYC ARAANWHDTALDYWGQGTLVTVSS (SEQ ID NO: 38) | DIQMTQSPSSLSASVGDRVTITCRASQSILSYVNWYQQK PGKAPKLLIYAATSRASGVPSRFSGSGSGTDFTLTISSL QPEDFATYYCQQSYSTPLTFGGGTKVEIK (SEQ ID NO: 95) |
| 370_H08 | EVQLLESGGGLVQPGGSLRLSCAASGFTFSSY GMHWVRQAPGKGLEWVASINYNGGYTSYADSV KGRFTISRDNSKNTLYLQMNSLRAEDTAVYYC ARAANWHDTHLDYWGQGTLVTVSS (SEQ ID NO: 39) | DIQMTQSPSSLSASVGDRVTITCRASQSILSYVNWYQQK PGKAPKLLIYAATSRHSGVPSRFSGSGSGTDFTLTISSL QPEDFATYYCQQSYSLPLTFGGGTKVEIK (SEQ ID NO: 96) |
| 371_A04 | EVQLLESGGGLVQPGGSLRLSCAASGFTFDSY GMNWVRQAPGKGLEWVSSINYNSGYTGYADSV KGRFTISRDNSKNTLYLQMNSLRAEDTAVYYC ARAANWHDTALDYWGQGTLVTVSS (SEQ ID NO: 40) | DIQMTQSPSSLSASVGDRVTITCRASQSILTYLNWYQQK PGKAPKLLIYAVTSRASGVPSRFSGSGSGTDFTLTISSL QPEDFATYYCQQSYDTPLTFGGGTKVEIK (SEQ ID NO: 97) |
| 371_A09 | EVQLLESGGGLVQPGGSLRLSCAASGFTFSSY GMNWVRQAPGKGLEWVSGINYNGGYKSYADSV KGRFTISRDNSKNTLYLQMNSLRAEDTAVYYC ARAANWHDTALDYWGQGTLVTVSS (SEQ ID NO: 41) | DIQMTQSPSSLSASVGDRVTITCRASQSIVTYVNWYQQK PGKAPKLVIYAATSRASGVPSRFSGSGSGTDFTLTISSL QPEDFATYYCQQSYDSPLTFGGGTKVEIK (SEQ ID NO: 98) |

TABLE 2A-continued

Group I Antibody Sequences

| Ab | VH sequence | VL sequence |
|---|---|---|
| 371_D07 | EVQLLESGGGLVQPGGSLRLSCAASGFTFDDYGMNWVRQAPGKGLEWVANINYNGGYKGYADSVKGRFTISRDNSKNTLYLQMNSLRAEDTAVYYCARAANWHDTHLDYWGQGTLVTVSS (SEQ ID NO: 42) | DIQMTQSPSSLSASVGDRVTITCRASQSILTYLNWYQQKPGKAPKLVIYAATSRASGVPSRFSGSGSGTDFTLTISSLQPEDFATYYCQQSYELPLTFGGGTKVEIK (SEQ ID NO: 99) |
| 371_D12 | EVQLLESGGGLVQPGGSLRLSCAASGFTFDSYGMNWVRQAPGKGLEWVSGINYNGGYKSYADSVKGRFTISRDNSKNTLYLQMNSLRAEDTAVYYCARAANWHDTALDYWGQGTLVTVSS (SEQ ID NO: 43) | DIQMTQSPSSLSASVGDRVTITCRASQSILSYLNWYQQKPGKAPKLLIYAATSRASGVPSRFSGSGSGTDFTLTISSLQPEDFATYYCQQSYELPLTFGGGTKVEIK (SEQ ID NO: 100) |
| 371_H02 | EVQLLESGGGLVQPGGSLRLSCAASGFTFDDYSMNWVRQAPGKGLEWVSGINYNGGYKSYADSVKGRFTISRDNSKNTLYLQMNSLRAEDTAVYYCARAANWHDTHLDYWGQGTLVTVSS (SEQ ID NO: 44) | DIQMTQSPSSLSASVGDRVTITCRASQSIISYLNWYQQKPGKAPKLVIYAATSLASGVPSRFSGSGSGTDFTLTISSLQPEDFATYYCQQSYENPLTFGGGTKVEIK (SEQ ID NO: 101) |
| 372_A09 | EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARAANWHDTALDYWGQGTLVTVSS (SEQ ID NO: 45) | DIQMTQSPSSLSASVGDRVTITCRASQSILSYLNWYQQKPGKAPKLVIYAATSRASGVPSRFSGSGSGTDFTLTISSLQPEDFATYYCQQSYNSPLTFGGGTKVEIK (SEQ ID NO: 102) |
| 372_B11 | EVQLLESGGGLVQPGGSLRLSCAASGFTFSSYSMHWVRQAPGKGLEWVAGINYNSGYTSYADSVKGRFTISRDNSKNTLYLQMNSLRAEDTAVYYCARAANWHDTHLDYWGQGTLVTVSS (SEQ ID NO: 46) | DIQMTQSPSSLSASVGDRVTITCRASQSILTYVNWYQQKPGKAPKLVIYAATSLASGVPSRFSGSGSGTDFTLTISSLQPEDFATYYCQQSYDTPLTFGGGTKVEIK (SEQ ID NO: 103) |
| 372_E02 | EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARAANWHDTALDYWGQGTLVTVSS (SEQ ID NO: 47) | DIQMTQSPSSLSASVGDRVTITCRASQSIISYVNWYQQKPGKAPKLVIYAATSRASGVPSRFSGSGSGTDFTLTISSLQPEDFATYYCQQSYDLPLTFGGGTKVEIK (SEQ ID NO: 104) |
| 373_E11 | EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTALDYWGQGTLVTVSS (SEQ ID NO: 48) | DIQMTQSPSSLSASVGDRVTITCRASQSIVSYLNWYQQKPGKAPKLVIYAATSRASGVPSRFSGSGSGTDFTLTISSLQPEDFATYYCQQSYDSPLTFGGGTKVEIK (SEQ ID NO: 105) |
| 373_H02 | EVQLLESGGGLVQPGGSLRLSCAASGFTFSSYGMHWVRQAPGKGLEWVAGINYNSGYTSYADSVKGRFTISRDNSKNTLYLQMNSLRAEDTAVYYCARAANWHDTALDYWGQGTLVTVSS (SEQ ID NO: 49) | DIQMTQSPSSLSASVGDRVTITCRASQSIVSYVNWYQQKPGKAPKLLIYAATSRHSGVPSRFSGSGSGTDFTLTISSLQPEDFATYYCQQSYXNPLTFGGGTKVEIK (SEQ ID NO: 106) |
| 374_B02 | EVQLLESGGGLVQPGGSLRLSCAASGFTFDSYSMHWVRQAPGKGLEWVAGINYNSGYTSYADSVKGRFTISRDNSKNTLYLQMNSLRAEDTAVYYCARAANWHDTHLDYWGQGTLVTVSS (SEQ ID NO: 50) | DIQMTQSPSSLSASVGDRVTITCRASQSIISYLNWYQQKPGKAPKLLIYAATSRASGVPSRFSGSGSGTDFTLTISSLQPEDFATYYCQQSYDSPLTFGGGTKVEIK (SEQ ID NO: 107) |
| 374_F03 | EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARAANWHDTHLDYWGQGTLVTVSS (SEQ ID NO: 51) | DIQMTQSPSSLSASVGDRVTITCRASQSIISYVNWYQQKPGKAPKLVIYAATSRASGVPSRFSGSGSGTDFTLTISSLQPEDFATYYCQQSYDTPLTFGGGTKVEIK (SEQ ID NO: 108) |
| 375_A04 | EVQLLESGGGLVQPGGSLRLSCAASGFTFDSYGMNWVRQAPGKGLEWVAGINYNGGYKSYADSVKGRFTISRDNSKNTLYLQMNSLRAEDTAVYYCARAANWHDTALDYWGQGTLVTVSS (SEQ ID NO: 52) | DIQMTQSPSSLSASVGDRVTITCRASQSILTYLNWYQQKPGKAPKLVIYYVNNLPSGVPSRFSGSGSGTDFTLTISSLQPEDFATYYCQQSYNSPLTFGGGTKVEIK (SEQ ID NO: 109) |
| 375_A11 | EVQLLESGGGLVQPGGSLRLSCAASGFTFSDYGMHWVRQAPGKGLEWVSSINYNSGYKSYADSVKGRFTISRDNSKNTLYLQMNSLRAEDTAVYYCARAANWHDTALDYWGQGTLVTVSS (SEQ ID NO: 53) | DIQMTQSPSSLSASVGDRVTITCRASQSIVSYLNWYQQKPGKAPKLLIYYVTNLASGVPSRFSGSGSGTDFTLTISSLQPEDFATYYCQQSYDNPLTFGGGTKVEIK (SEQ ID NO: 110) |

TABLE 2A-continued

Group I Antibody Sequences

| Ab | VH sequence | VL sequence |
|---|---|---|
| 375_C10 | EVQLLESGGGLVQPGGSLRLSCAASGFTFSSY GMHWVRQAPGKGLEWVASINYNGGYTSYADSV KGRFTISRDNSKNTLYLQMNSLRAEDTAVYYC ARAANWHDTALDYWGQGTLVTVSS (SEQ ID NO: 54) | DIQMTQSPSSLSASVGDRVTITCRASQSISTYLNWYQQK PGKAPKLVIYAASSLQSGVPSRFSGSGSGTDFTLTISSL QPEDFATYYCQQSYSTPLTFGGGTKVEIK (SEQ ID NO: 111) |
| 375_F12 | EVQLLESGGGLVQPGGSLRLSCAASGFTFDSY GMHWVRQAPGKGLEWVASINYNGGYTSYADSV KGRFTISRDNSKNTLYLQMNSLRAEDTAVYYC ARAANWHDTALDYWGQGTLVTVSS (SEQ ID NO: 55) | DIQMTQSPSSLSASVGDRVTITCRASQSILTYLNWYQQK PGKAPKLVIYAATSRASGVPSRFSGSGSGTDFTLTISSL QPEDFATYYCQQSDELPLTFGGGTKVEIK (SEQ ID NO: 112) |
| 375_H01 | EVQLLESGGGLVQPGGSLRLSCAASGFTFSDY SMNWVRQAPGKGLEWVAGINYNSGYTSYADSV KGRFTISRDNSKNTLYLQMNSLRAEDTAVYYC ARAANWHDTHLDYWGQGTLVTVSS (SEQ ID NO: 56) | DIQMTQSPSSLSASVGDRVTITCRASQSILTYLNWYQQK PGKAPKLLIYAATSRHSGVPSRFSGSGSGTDFTLTISSL QPEDFATYYCQQSYSNPLTFGGGTKVEIK (SEQ ID NO: 113) |
| 376_G02 | EVQLLESGGGLVQPGGSLRLSCAASGFTFSDY GMNWVRQAPGKGLEWVSGINYNGGYTSYADSV KGRFTISRDNSKNTLYLQMNSLRAEDTAVYYC ARAANWHDTALDYWGQGTLVTVSS (SEQ ID NO: 57) | DIQMTQSPSSLSASVGDRVTITCRASQSISRYLNWYQQK PGKAPKLVIYAATSLASGVPSRFSGSGSGTDFTLTISSL QPEDFATYYCQQSYDNPLTFGGGTKVEIK (SEQ ID NO: 114) |

Table 3A provides the amino acid sequences of the CDRs of the antibodies shown in Table 2A.

TABLE 3A

CDR sequences for Group I antibodies

| Ab | HCDR1 | HCDR2 | HCDR3 | LCDR1 | LCDR2 | LCDR3 |
|---|---|---|---|---|---|---|
| 365_B04 | SSYGMH (SEQ ID NO: 115) | WVASINYNSGYTS (SEQ ID NO: 172) | ARAANWHDTALD (SEQ ID NO: 229) | LTYLNWY (SEQ ID NO: 286) | LLIYAATSRH (SEQ ID NO: 343) | QQSDESPL (SEQ ID NO: 400) |
| 365_B10 | DDYSMH (SEQ ID NO: 116) | WVASINYNSGYKG (SEQ ID NO: 173) | ARAANWHDTALD (SEQ ID NO: 230) | LRYLNWY (SEQ ID NO: 287) | LLIYAATSRA (SEQ ID NO: 344) | QQSDNLPL (SEQ ID NO: 401) |
| 365_C03 | SSYGMH (SEQ ID NO: 117) | WVAGINYNSGYKG (SEQ ID NO: 174) | ARAANWHDTHLD (SEQ ID NO: 231) | LTYVNWY (SEQ ID NO: 288) | LVIYATTSLA (SEQ ID NO: 345) | QQSYNTPL (SEQ ID NO: 402) |
| 365_C06 | SDYGMH (SEQ ID NO: 118) | WVSGINYNGGYTS (SEQ ID NO: 175) | ARAANWHDTALD (SEQ ID NO: 232) | STYVNWY (SEQ ID NO: 289) | LLIYAVTSLA (SEQ ID NO: 346) | QQSYDNPL (SEQ ID NO: 403) |
| 365_D04 | SDYGMH (SEQ ID NO: 119) | WVAGINYNGGYKS (SEQ ID NO: 176) | ARAANWHDTALD (SEQ ID NO: 233) | SSYLNWY (SEQ ID NO: 290) | LVIYAVTSRA (SEQ ID NO: 347) | QQSYDLPL (SEQ ID NO: 404) |
| 365_E04 | DSYGMH (SEQ ID NO: 120) | WVASINYNGGYKS (SEQ ID NO: 177) | ARAANWHDTALD (SEQ ID NO: 234) | LSYVNWY (SEQ ID NO: 291) | LLIYAATSLA (SEQ ID NO: 348) | QQSYELPL (SEQ ID NO: 405) |
| 365_F11 | DSYSMN (SEQ ID NO: 121) | WVSGINYNSGYKG (SEQ ID NO: 178) | ARAANWHDTHLD (SEQ ID NO: 235) | ISYVNWY (SEQ ID NO: 292) | LLIYAATSRA (SEQ ID NO: 349) | QQSYNTPL (SEQ ID NO: 406) |
| 365_G07 | DSYGMH (SEQ ID NO: 122) | WVSSINYNGGYTS (SEQ ID NO: 179) | ARAANWHDTALD (SEQ ID NO: 236) | VSYLNWY (SEQ ID NO: 293) | LLIYAATSRA (SEQ ID NO: 350) | QQSYDNPL (SEQ ID NO: 407) |

TABLE 3A-continued

CDR sequences for Group I antibodies

| Ab | HCDR1 | HCDR2 | HCDR3 | LCDR1 | LCDR2 | LCDR3 |
|---|---|---|---|---|---|---|
| 365_H08 | SSYGMH (SEQ ID NO: 123) | WVASINYNGGYKS (SEQ ID NO: 180) | ARAANWHDTALD (SEQ ID NO: 237) | SSYLNWY (SEQ ID NO: 294) | LLIYAASSLQ (SEQ ID NO: 351) | QQSYSTPL (SEQ ID NO: 408) |
| 366_A02 | DSYGMN (SEQ ID NO: 124) | WVASINYNSGYKG (SEQ ID NO: 181) | ARAANWHDTHLD (SEQ ID NO: 238) | VSYVNWY (SEQ ID NO: 295) | LLIYAATSRA (SEQ ID NO: 352) | QQSYDLPL (SEQ ID NO: 409) |
| 366_A04 | SSYGMN (SEQ ID NO: 125) | WVAGINYNGGYTS (SEQ ID NO: 182) | ARAANWHDTALD (SEQ ID NO: 239) | LTYLNWY (SEQ ID NO: 296) | LVIYAATSLA (SEQ ID NO: 353) | QQSDDSPL (SEQ ID NO: 410) |
| 366_D01 | SSYGMH (SEQ ID NO: 126) | WVSSINYNGGYTG (SEQ ID NO: 183) | ARAANWHDTHLD (SEQ ID NO: 240) | LTYVNWY (SEQ ID NO: 297) | LLIYAATSRA (SEQ ID NO: 354) | QQSYENPL (SEQ ID NO: 411) |
| 366_D03 | DSYGMH (SEQ ID NO: 127) | WVSSINYNGGYTG (SEQ ID NO: 184) | ARAANWHDTHLD (SEQ ID NO: 241) | LSYVNWY (SEQ ID NO: 298) | LLIYAATSRA (SEQ ID NO: 355) | QQSYDLPL (SEQ ID NO: 412) |
| 366_F10 | DSYSMN (SEQ ID NO: 128) | WVAGINYNGGYTG (SEQ ID NO: 185) | ARAANWHDTHLD (SEQ ID NO: 242) | VSYLNWY (SEQ ID NO: 299) | LVIYAATSRA (SEQ ID NO: 356) | QQSYDTPL (SEQ ID NO: 413) |
| 366_G06 | SSYGMH (SEQ ID NO: 129) | WVASINYNGGYTG (SEQ ID NO: 186) | ARAANWHDTHLD (SEQ ID NO: 243) | VSYVNWY (SEQ ID NO: 300) | LVIYAATSRA (SEQ ID NO: 357) | QQSYDNPL (SEQ ID NO: 414) |
| 367_B09 | DSYGMH (SEQ ID NO: 130) | WVASINYNGGYTS (SEQ ID NO: 187) | ARAANWHDTALD (SEQ ID NO: 244) | LSYVNWY (SEQ ID NO: 301) | LVIYAATSRA (SEQ ID NO: 358) | QQSYENPL (SEQ ID NO: 415) |
| 367_B11 | SDYSMH (SEQ ID NO: 131) | WVANINYNSGYTS (SEQ ID NO: 188) | ARAANWHDTALD (SEQ ID NO: 245) | LSYLNWY (SEQ ID NO: 302) | LVIYAATSRA (SEQ ID NO: 359) | QQSYSTPL (SEQ ID NO: 416) |
| 367_C09 | DSYGMH (SEQ ID NO: 132) | WVASINYNGGYTS (SEQ ID NO: 189) | ARAANWHDTHLD (SEQ ID NO: 246) | LSYVNWY (SEQ ID NO: 303) | LVIYAATSRH (SEQ ID NO: 360) | QQSYNTPL (SEQ ID NO: 417) |
| 367_D11 | DSYGMH (SEQ ID NO: 133) | WVSNINYNGGYKS (SEQ ID NO: 190) | ARAANWHDTALD (SEQ ID NO: 247) | ISYLNWY (SEQ ID NO: 304) | LLIYAATSRA (SEQ ID NO: 361) | QQSYDSPL (SEQ ID NO: 418) |
| 367_F06 | SSYGMN (SEQ ID NO: 134) | WVSSINYNSGYTS (SEQ ID NO: 191) | ARAANWHDTALD (SEQ ID NO: 248) | SSYVNWY (SEQ ID NO: 305) | LLIYAVTSRA (SEQ ID NO: 362) | QQSYDSPL (SEQ ID NO: 419) |
| 367_H01 | DSYGMN (SEQ ID NO: 135) | WVSGINYNGGYKS (SEQ ID NO: 192) | ARAANWHDTALD (SEQ ID NO: 249) | LTYLNWY (SEQ ID NO: 306) | LVIYAATSRA (SEQ ID NO: 363) | QQSYDNPL (SEQ ID NO: 420) |
| 368_A02 | DSYGMN (SEQ ID NO: 136) | WVAGINYNGGYKS (SEQ ID NO: 193) | ARAANWHDTHLD (SEQ ID NO: 250) | ISYVNWY (SEQ ID NO: 307) | LVIYAATSRA (SEQ ID NO: 364) | QQSYDTPL (SEQ ID NO: 421) |
| 368_A06 | DSYSMH (SEQ ID NO: 137) | WVAGINYNSGYKG (SEQ ID NO: 194) | ARAANWHDTHLD (SEQ ID NO: 251) | LSYVNWY (SEQ ID NO: 308) | LLIYAATSRH (SEQ ID NO: 365) | QQSYNSPL (SEQ ID NO: 422) |

TABLE 3A-continued

CDR sequences for Group I antibodies

| Ab | HCDR1 | HCDR2 | HCDR3 | LCDR1 | LCDR2 | LCDR3 |
|---|---|---|---|---|---|---|
| 368_A12 | DSYSMH (SEQ ID NO: 138) | WVSSINYNSGYKG (SEQ ID NO: 195) | ARAANWHDTALD (SEQ ID NO: 252) | LTYLNWY (SEQ ID NO: 309) | LVIYAATSRA (SEQ ID NO: 366) | QQSYDSPL (SEQ ID NO: 423) |
| 368_B03 | DDYGMN (SEQ ID NO: 139) | WVSGINYNGGYTS (SEQ ID NO: 196) | ARAANWHDTALD (SEQ ID NO: 253) | LTYLNWY (SEQ ID NO: 310) | LVIYAATSLA (SEQ ID NO: 367) | QHSYENPL (SEQ ID NO: 424) |
| 368_B08 | DSYGMN (SEQ ID NO: 140) | WVSSINYNGGYTS (SEQ ID NO: 197) | ARAANWHDTHLD (SEQ ID NO: 254) | LTYVNWY (SEQ ID NO: 311) | LVIYAATSRA (SEQ ID NO: 368) | QQSYENPL (SEQ ID NO: 425) |
| 368_B10 | DSYGMH (SEQ ID NO: 141) | WVASINYNGGYTS (SEQ ID NO: 198) | ARAANWHDTALD (SEQ ID NO: 255) | LTYLNWY (SEQ ID NO: 312) | LVIYAATSRA (SEQ ID NO: 369) | QQSDELPL (SEQ ID NO: 426) |
| 368_B11 | DSYGMH (SEQ ID NO: 142) | WVSGINYNGGYKS (SEQ ID NO: 199) | ARAANWHDTHLD (SEQ ID NO: 256) | LSYLNWY (SEQ ID NO: 313) | LLIYAASSLQ (SEQ ID NO: 370) | QQSYDSPL (SEQ ID NO: 427) |
| 368_C09 | SSYSMH (SEQ ID NO: 143) | WVSNINYNGGYTG (SEQ ID NO: 200) | ARAANWHDTHLD (SEQ ID NO: 257) | LTYVNWY (SEQ ID NO: 314) | LLIYAATSLA (SEQ ID NO: 371) | QQSYDLPL (SEQ ID NO: 428) |
| 368_D09 | DSYGMH (SEQ ID NO: 144) | WVAGINYNSGYKS (SEQ ID NO: 201) | ARAANWHDTHLD (SEQ ID NO: 258) | VSYVNWY (SEQ ID NO: 315) | LLIYAATSLA (SEQ ID NO: 372) | QQSYDNPL (SEQ ID NO: 429) |
| 368_F02 | SSYGMN (SEQ ID NO: 145) | WVASINYNSGYTS (SEQ ID NO: 202) | ARAANWHDTHLD (SEQ ID NO: 259) | LSYLNWY (SEQ ID NO: 316) | LLIYAASSLQ (SEQ ID NO: 373) | QQSYSLPL (SEQ ID NO: 430) |
| 368_F10 | SSYGMN (SEQ ID NO: 146) | WVAGINYNSGYTS (SEQ ID NO: 203) | ARAANWHDTHLD (SEQ ID NO: 260) | VSYVNWY (SEQ ID NO: 317) | LLIYAATSRA (SEQ ID NO: 374) | QQSYDTPL (SEQ ID NO: 431) |
| 369_B03 | SSYGMH (SEQ ID NO: 147) | WVAGINYNGGYTS (SEQ ID NO: 204) | ARAANWHDTALD (SEQ ID NO: 261) | LTYVNWY (SEQ ID NO: 318) | LVIYAATSLA (SEQ ID NO: 375) | QQSYELPL (SEQ ID NO: 432) |
| 369_G10 | SSYGMH (SEQ ID NO: 148) | WVASINYNGGYTS (SEQ ID NO: 205) | ARAANWHDTALD (SEQ ID NO: 262) | LSYLNWY (SEQ ID NO: 319) | LVIYAATSRA (SEQ ID NO: 376) | QQSYDSPL (SEQ ID NO: 433) |
| 369_H03 | SSYSMH (SEQ ID NO: 149) | WVASINYNSGYKS (SEQ ID NO: 206) | ARAANWHDTALD (SEQ ID NO: 263) | VSYLNWY (SEQ ID NO: 320) | LLIYATTSRA (SEQ ID NO: 377) | QQSYDTPL (SEQ ID NO: 434) |
| 370_B01 | DDYGMH (SEQ ID NO: 150) | WVSGINYNGGYKS (SEQ ID NO: 207) | ARAANWHDTALD (SEQ ID NO: 264) | LSYVNWY (SEQ ID NO: 321) | LLIYVASSRA (SEQ ID NO: 378) | QQSYSLPL (SEQ ID NO: 435) |
| 370_D06 | SSYGMN (SEQ ID NO: 151) | WVASINYNGGYTS (SEQ ID NO: 208) | ARAANWHDTHLD (SEQ ID NO: 265) | ISYLNWY (SEQ ID NO: 322) | LVIYAATSLA (SEQ ID NO: 379) | QQSYSSPL (SEQ ID NO: 436) |
| 370_G04 | SSYGMH (SEQ ID NO: 152) | WVSGINYNGGYTG (SEQ ID NO: 209) | ARAANWHDTALD (SEQ ID NO: 266) | LSYVNWY (SEQ ID NO: 323) | LLIYAATSRA (SEQ ID NO: 380) | QQSYSTPL (SEQ ID NO: 437) |

TABLE 3A-continued

CDR sequences for Group I antibodies

| Ab | HCDR1 | HCDR2 | HCDR3 | LCDR1 | LCDR2 | LCDR3 |
|---|---|---|---|---|---|---|
| 370_H08 | SSYGMH (SEQ ID NO: 153) | WVASINYNGGYTS (SEQ ID NO: 210) | ARAANWHDTHLD (SEQ ID NO: 267) | LSYVNWY (SEQ ID NO: 324) | LLIYAATSRH (SEQ ID NO: 381) | QQSYSLPL (SEQ ID NO: 438) |
| 371_A04 | DSYGMN (SEQ ID NO: 154) | WVSSINYNSGYTG (SEQ ID NO: 211) | ARAANWHDTALD (SEQ ID NO: 268) | LTYLNWY (SEQ ID NO: 325) | LLIYAVTSRA (SEQ ID NO: 382) | QQSYDTPL (SEQ ID NO: 439) |
| 371_A09 | SSYGMN (SEQ ID NO: 155) | WVSGINYNGGYKS (SEQ ID NO: 212) | ARAANWHDTALD (SEQ ID NO: 269) | VTYVNWY (SEQ ID NO: 326) | LVIYAATSRA (SEQ ID NO: 383) | QQSYDSPL (SEQ ID NO: 440) |
| 371_D07 | DDYGMN (SEQ ID NO: 156) | WVANINYNGGYKG (SEQ ID NO: 213) | ARAANWHDTHLD (SEQ ID NO: 270) | LTYLNWY (SEQ ID NO: 327) | LVIYAATSRA (SEQ ID NO: 384) | QQSYELPL (SEQ ID NO: 441) |
| 371_D12 | DSYGMN (SEQ ID NO: 157) | WVSGINYNGGYKS (SEQ ID NO: 214) | ARAANWHDTALD (SEQ ID NO: 271) | LSYLNWY (SEQ ID NO: 328) | LLIYAATSRA (SEQ ID NO: 385) | QQSYELPL (SEQ ID NO: 442) |
| 371_H02 | DDYSMN (SEQ ID NO: 158) | WVSGINYNGGYKS (SEQ ID NO: 215) | ARAANWHDTHLD (SEQ ID NO: 272) | ISYLNWY (SEQ ID NO: 329) | LVIYAATSLA (SEQ ID NO: 386) | QQSYENPL (SEQ ID NO: 443) |
| 372_A09 | DSYGMN (SEQ ID NO: 159) | WVSGINYNGGYTS (SEQ ID NO: 216) | ARAANWHDTALD (SEQ ID NO: 273) | LSYLNWY (SEQ ID NO: 330) | LVIYAATSRA (SEQ ID NO: 387) | QQSYNSPL (SEQ ID NO: 444) |
| 372_B11 | SSYSMH (SEQ ID NO: 160) | WVAGINYNSGYTS (SEQ ID NO: 217) | ARAANWHDTHLD (SEQ ID NO: 274) | LTYVNWY (SEQ ID NO: 331) | LVIYAATSLA (SEQ ID NO: 388) | QQSYDTPL (SEQ ID NO: 445) |
| 372_E02 | SSYGMN (SEQ ID NO: 161) | WVASINYNGGYTS (SEQ ID NO: 218) | ARAANWHDTALD (SEQ ID NO: 275) | ISYVNWY (SEQ ID NO: 332) | LVIYAATSRA (SEQ ID NO: 389) | QQSYDLPL (SEQ ID NO: 446) |
| 373_E11 | DSYGMH (SEQ ID NO: 162) | WVSINYNGGYTS (SEQ ID NO: 219) | ARAANWHDTALD (SEQ ID NO: 276) | VSYLNWY (SEQ ID NO: 333) | LVIYAATSRA (SEQ ID NO: 390) | QQSYDSPL (SEQ ID NO: 447) |
| 373_H02 | SSYGMH (SEQ ID NO: 163) | WVAGINYNSGYTS (SEQ ID NO: 220) | ARAANWHDTALD (SEQ ID NO: 277) | VSYVNWY (SEQ ID NO: 334) | LLIYAATSRH (SEQ ID NO: 391) | QQSYXNPL (SEQ ID NO: 448) |
| 374_B02 | DSYSMH (SEQ ID NO: 164) | WVAGINYNSGYTS (SEQ ID NO: 221) | ARAANWHDTHLD (SEQ ID NO: 278) | ISYLNWY (SEQ ID NO: 335) | LLIYAATSRA (SEQ ID NO: 392) | QQSYDSPL (SEQ ID NO: 449) |
| 374_F03 | SSYGMN (SEQ ID NO: 165) | WVASINYNGGYTS (SEQ ID NO: 222) | ARAANWHDTHLD (SEQ ID NO: 279) | ISYVNWY (SEQ ID NO: 336) | LVIYAATSRA (SEQ ID NO: 393) | QQSYDTPL (SEQ ID NO: 450) |
| 375_A04 | DSYGMN (SEQ ID NO: 166) | WVAGINYNGGYKS (SEQ ID NO: 223) | ARAANWHDTALD (SEQ ID NO: 280) | LTYLNWY (SEQ ID NO: 337) | LVIYYVNNLP (SEQ ID NO: 394) | QQSYNSPL (SEQ ID NO: 451) |
| 375_A11 | SDYGMH (SEQ ID NO: 167) | WVSSINYNSGYKS (SEQ ID NO: 224) | ARAANWHDTALD (SEQ ID NO: 281) | VSYLNWY (SEQ ID NO: 338) | LLIYYVTNLA (SEQ ID NO: 395) | QQSYDNPL (SEQ ID NO: 452) |

TABLE 3A-continued

CDR sequences for Group I antibodies

| Ab | HCDR1 | HCDR2 | HCDR3 | LCDR1 | LCDR2 | LCDR3 |
|---|---|---|---|---|---|---|
| 375_C10 | SSYGMH (SEQ ID NO: 168) | WVASINYNGGYTS (SEQ ID NO: 225) | ARAANWHDTALD (SEQ ID NO: 282) | STYLNWY (SEQ ID NO: 339) | LVIYAASSLQ (SEQ ID NO: 396) | QQSYSTPL (SEQ ID NO: 453) |
| 375_F12 | DSYGMH (SEQ ID NO: 169) | WVASINYNGGYTS (SEQ ID NO: 226) | ARAANWHDTALD (SEQ ID NO: 283) | LTYLNWY (SEQ ID NO: 340) | LVIYAATSRA (SEQ ID NO: 397) | QQSDELPL (SEQ ID NO: 454) |
| 375_H01 | SDYSMN (SEQ ID NO: 170) | WVAGINYNSGYTS (SEQ ID NO: 227) | ARAANWHDTHLD (SEQ ID NO: 284) | LTYLNWY (SEQ ID NO: 341) | LLIYAATSRH (SEQ ID NO: 398) | QQSYSNPL (SEQ ID NO: 455) |
| 376_G02 | SDYGMN (SEQ ID NO: 171) | WVSGINYNGGYTS (SEQ ID NO: 228) | ARAANWHDTALD (SEQ ID NO: 285) | SRYLNWY (SEQ ID NO: 342) | LVIYAATSLA (SEQ ID NO: 399) | QQSYDNPL (SEQ ID NO: 456) |

The consensus sequences for each of these CDRs shown in FIG. 3A are as follows:

HCDR1:
(SEQ ID NO: 6550)
D/SS/DYG/SMH/N

HCDR2:
(SEQ ID NO: 6551)
WVA/SS/G/NINYNG/SGYT/KS/G

HCDR3:
(SEQ ID NO: 6552)
ARAANWHDTA/HLD

LCDR1:
(SEQ ID NO: 6554)
L/V/I/SS/T/RYL/VNWY

LCDR2:
(SEQ ID NO: 6592)
LV/LIYA/Y/VA/V/TT/S/NS/NR/LA/H/Q/P

LCDR3:
(SEQ ID NO: 6593)
QQ/HSY/DD/E/S/NL/N/S/TPL

TABLE 2B

Group II Antibody Sequences

| Ab | VH sequence | VL sequence |
|---|---|---|
| 365_A05 | EVQLLESGGGLVQPGGSLRLSCAASGFTFSSY GMHWVRQAPGKGLEWVSSINYNGGYTSYADSV KGRFTISRDNSKNTLYLQMNSLRAEDTAVYYC ARAATWHDTHLDYWGQGTLVTVSS (SEQ ID NO: 457) | DIQMTQSPSSLSASVGDRVTITCRASQSISSYLNWYQQ KPGKAPKLLIYAASSLQSGVPSRFSGSGSGTDFTLTIS SLQPEDFATYYCQQSYSTPLTFGGGTKVEIK (SEQ ID NO: 528) |
| 365_B08 | EVQLLESGGGLVQPGGSLRLSCAASGFTFDSY GMNWVRQAPGKGLEWVSNINYNSGYKGYADSV KGRFTISRDNSKNTLYLQMNSLRAEDTAVYYC ARAATWHDTHLDYWGQGTLVTVSS (SEQ ID NO: 458) | DIQMTQSPSSLSASVGDRVTITCRASQSIVTYLNWYQQ KPGKAPKLLIYAATSRASGVPSRFSGSGSGTDFTLTIS SLQPEDFATYYCQQSYSSPLTFGGGTKVEIK (SEQ ID NO: 529) |
| 365_B12 | EVQLLESGGGLVQPGGSLRLSCAASGFTFSDY GMHWVRQAPGKGLEWVSGINYNGGYTSYADSV KGRFTISRDNSKNTLYLQMNSLRAEDTAVYYC ARAATWHDTHLDYWGQGTLVTVSS (SEQ ID NO: 459) | DIQMTQSPSSLSASVGDRVTITCRASQSISTYVNWYQQ KPGKAPKLLIYAVTSLHSGVPSRFSGSGSGTDFTLTIS SLQPEDFATYYCQQSYDNPLTFGGGTKVEIK (SEQ ID NO: 530) |
| 365_D03 | EVQLLESGGGLVQPGGSLRLSCAASGFTFDDY SMHWVRQAPGKGLEWVASINYNGGYKSYADSV KGRFTISRDNSKNTLYLQMNSLRAEDTAVYYC ARAATWHDTHLDYWGQGTLVTVSS (SEQ ID NO: 460) | DIQMTQSPSSLSASVGDRVTITCRASQSIVSYLNWYQQ KPGKAPKLVIYAATSRASGVPSRFSGSGSGTDFTLTIS SLQPEDFATYYCQQSYDSPLTFGGGTKVEIK (SEQ ID NO: 531) |
| 365_D08 | EVQLLESGGGLVQPGGSLRLSCAASGFTFDSY SMHWVRQAPGKGLEWVSSINYNGGYTSYADSV KGRFTISRDNSKNTLYLQMNSLRAEDTAVYYC ARAATWHDTHLDYWGQGTLVTVSS (SEQ ID NO: 461) | DIQMTQSPSSLSASVGDRVTITCRASQSIITYVNWYQQ KPGKAPKLLIYAATSRASGVPSRFSGSGSGTDFTLTIS SLQPEDFATYYCQQSYDTPLTFGGGTKVEIK (SEQ ID NO: 532) |

TABLE 2B-continued

Group II Antibody Sequences

| Ab | VH sequence | VL sequence |
|---|---|---|
| 365_E06 | EVQLLESGGGLVQPGGSLRLSCAASGFTFDSYGMNWVRQAPGKGLEWVSGINYNGGYTGYADSVKGRFTISRDNSKNTLYLQMNSLRAEDTAVYYCARAATWHDTHLDYWGQGTLVTVSS (SEQ ID NO: 462) | DIQMTQSPSSLSASVGDRVTITCRASQSILTYLNWYQQKPGKAPKLVIYAATSRASGVPSRFSGSGSGTDFTLTISSLQPEDFATYYCQQSYNTPLTFGGGTKVEIK (SEQ ID NO: 533) |
| 365_F10 | EVQLLESGGGLVQPGGSLRLSCAASGFTFDDYGMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 463) | DIQMTQSPSSLSASVGDRVTITCRASQSIVTYVNWYQQKPGKAPKLLIYAATSRASGVPSRFSGSGSGTDFTLTISSLQPEDFATYYCQQSYELPLTFGGGTKVEIK (SEQ ID NO: 534) |
| 365_G06 | EVQLLESGGGLVQPGGSLRLSCAASGFTFDSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 464) | DIQMTQSPSSLSASVGDRVTITCRASQSILSYLNWYQQKPGKAPKLLIYAATSLASGVPSRFSGSGSGTDFTLTISSLQPEDFATYYCQQSDSTPLTFGGGTKVEIK (SEQ ID NO: 535) |
| 365_G08 | EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 465) | DIQMTQSPSSLSASVGDRVTITCRASQSISSYLNWYQQKPGKAPKLLIYAASSLQSGVPSRFSGSGSGTDFTLTISSLQPEDFATYYCQQSYETPLTFGGGTKVEIK (SEQ ID NO: 536) |
| 366_B09 | EVQLLESGGGLVQPGGSLRLSCAASGFTFSDYGMHWVRQAPGKGLEWVSSINYNSGYKSYADSVKGRFTISRDNSKNTLYLQMNSLRAEDTAVYYCARAATWHDTHLDYWGQGTLVTVSS (SEQ ID NO: 466) | DIQMTQSPSSLSASVGDRVTITCRASQSILTYLNWYQQKPGKAPKLVIYAATSRHSGVPSRFSGSGSGTDFTLTISSLQPEDFATYYCQQSYDSPLTFGGGTKVEIK (SEQ ID NO: 537) |
| 366_C05 | EVQLLESGGGLVQPGGSLRLSCAASGFTFDDYGMHWVRQAPGKGLEWVSSINYNGGYTGYADSVKGRFTISRDNSKNTLYLQMNSLRAEDTAVYYCARAATWHDTHLDYWGQGTLVTVSS (SEQ ID NO: 467) | DIQMTQSPSSLSASVGDRVTITCRASQSIISYLNWYQQKPGKAPKLVIYAATSRASGVPSRFSGSGSGTDFTLTISSLQPEDFATYYCQQSYDSPLTFGGGTKVEIK (SEQ ID NO: 538) |
| 366_E07 | EVQLLESGGGLVQPGGSLRLSCAASGFTFDSYGMHWVRQAPGKGLEWVAGINYNGGYTSYADSVKGRFTISRDNSKNTLYLQMNSLRAEDTAVYYCARAATWHDTALDYWGQGTLVTVSS (SEQ ID NO: 468) | DIQMTQSPSSLSASVGDRVTITCRASQSILTYLNWYQQKPGKAPKLVIYAATSRHSGVPSRFSGSGSGTDFTLTISSLQPEDFATYYCQQSDNSPLTFGGGTKVEIK (SEQ ID NO: 539) |
| 366_G02 | EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAATWHDTHLDYWGQGTLVTVSS (SEQ ID NO: 469) | DIQMTQSPSSLSASVGDRVTITCRASQSILTYLNWYQQKPGKAPKLLIYAATSRHSGVPSRFSGSGSGTDFTLTISSLQPEDFATYYCQQSDDNPLTFGGGTKVEIK (SEQ ID NO: 540) |
| 366_H01 | EVQLLESGGGLVQPGGSLRLSCAASGFTFDDYSMHWVRQAPGKGLEWVANINYNGGYTSYADSVKGRFTISRDNSKNTLYLQMNSLRAEDTAVYYCARAATWHDTHLDYWGQGTLVTVSS (SEQ ID NO: 470) | DIQMTQSPSSLSASVGDRVTITCRASQSILTYLNWYQQKPGKAPKLVIYATTSRHSGVPSRFSGSGSGTDFTLTISSLQPEDFATYYCQQSYESPLTFGGGTKVEIK (SEQ ID NO: 541) |
| 367_C06 | EVQLLESGGGLVQPGGSLRLSCAASGFTFDSYSMHWVRQAPGKGLEWVASINYNGGYKSYADSVKGRFTISRDNSKNTLYLQMNSLRAEDTAVYYCARAATWHDTHLDYWGQGTLVTVSS (SEQ ID NO: 471) | DIQMTQSPSSLSASVGDRVTITCRASQSILTYLNWYQQKPGKAPKLVIYAATSLHSGVPSRFSGSGSGTDFTLTISSLQPEDFATYYCQQSYDTPLTFGGGTKVEIK (SEQ ID NO: 542) |
| 367_C12 | EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 472) | DIQMTQSPSSLSASVGDRVTITCRASQSILSYVNWYQQKPGKAPKLLIYATTSRHSGVPSRFSGSGSGTDFTLTISSLQPEDFATYYCQQSYESPLTFGGGTKVEIK (SEQ ID NO: 543) |
| 367_E08 | EVQLLESGGGLVQPGGSLRLSCAASGFTFSDYGMNWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 473) | DIQMTQSPSSLSASVGDRVTITCRASQSILSYLNWYQQKPGKAPKLLIYATTSRASGVPSRFSGSGSGTDFTLTISSLQPEDFATYYCQQSYDNPLTFGGGTKVEIK (SEQ ID NO: 544) |

TABLE 2B-continued

Group II Antibody Sequences

| Ab | VH sequence | VL sequence |
|---|---|---|
| 367_E10 | EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARAATWHDTHLDYWGQGTLVTVSS (SEQ ID NO: 474) | DIQMTQSPSSLSASVGDRVTITCRASQSILSYVNWYQQKPGKAPKLLIYAATSRASGVPSRFSGSGSGTDFTLTISSLQPEDFATYYCQQSYELPLTFGGGTKVEIK (SEQ ID NO: 545) |
| 367_F08 | EVQLLESGGGLVQPGGSLRLSCAASGFTFSSYGMHWVRQAPGKGLEWVSSINYNSGYTSYADSVKGRFTISRDNSKNTLYLQMNSLRAEDTAVYYCARAATWHDTHLDYWGQGTLVTVSS (SEQ ID NO: 475) | DIQMTQSPSSLSASVGDRVTITCRASQSILSYVNWYQQKPGKAPKLVIYAATSRASGVPSRFSGSGSGTDFTLTISSLQPEDFATYYCQQSNELPLTFGGGTKVEIK (SEQ ID NO: 546) |
| 367_F10 | EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARAATWHDTHLDYWGQGTLVTVSS (SEQ ID NO: 476) | DIQMTQSPSSLSASVGDRVTITCRASQSILTYLNWYQQKPGKAPKLLIYAATSRASGVPSRFSGSGSGTDFTLTISSLQPEDFATYYCQQSYDTPLTFGGGTKVEIK (SEQ ID NO: 547) |
| 367_G03 | EVQLLESGGGLVQPGGSLRLSCAASGFTFDSYSMHWVRQAPGKGLEWVANINYNGGYTSYADSVKGRFTISRDNSKNTLYLQMNSLRAEDTAVYYCARAATWHDTHLDYWGQGTLVTVSS (SEQ ID NO: 477) | DIQMTQSPSSLSASVGDRVTITCRASQSIVSYVNWYQQKPGKAPKLVIYAATSRHSGVPSRFSGSGSGTDFTLTISSLQPEDFATYYCQQSYDLPLTFGGGTKVEIK (SEQ ID NO: 548) |
| 367_G11 | EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 478) | DIQMTQSPSSLSASVGDRVTITCRASQSILTYLNWYQQKPGKAPKLLIYAATSRHSGVPSRFSGSGSGTDFTLTISSLQPEDFATYYCQQSDDSPLTFGGGTKVEIK (SEQ ID NO: 549) |
| 367_H08 | EVQLLESGGGLVQPGGSLRLSCAASGFTFDSYGMNWVRQAPGKGLEWVSSINYNGGYTSYADSVKGRFTISRDNSKNTLYLQMNSLRAEDTAVYYCARAATWHDTHLDYWGQGTLVTVSS (SEQ ID NO: 479) | DIQMTQSPSSLSASVGDRVTITCRASQSILTYVNWYQQKPGKAPKLLIYAATSRHSGVPSRFSGSGSGTDFTLTISSLQPEDFATYYCQQSYNLPLTFGGGTKVEIK (SEQ ID NO: 550) |
| 368_B04 | EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAATWHDTHLDYWGQGTLVTVSS (SEQ ID NO: 480) | DIQMTQSPSSLSASVGDRVTITCRASQSIVSYLNWYQQKPGKAPKLVIYAATSRASGVPSRFSGSGSGTDFTLTISSLQPEDFATYYCQQSYENPLTFGGGTKVEIK (SEQ ID NO: 551) |
| 368_B12 | EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCARAATWHDTHLDYWGQGTLVTVSS (SEQ ID NO: 481) | DIQMTQSPSSLSASVGDRVTITCRASQSIVSYVNWYQQKPGKAPKLLIYAATSRASGVPSRFSGSGSGTDFTLTISSLQPEDFATYYCQQSYDLPLTFGGGTKVEIK (SEQ ID NO: 552) |
| 368_C04 | EVQLLESGGGLVQPGGSLRLSCAASGFTFDSYGMHWVRQAPGKGLEWVSNINYNGGYTSYADSVKGRFTISRDNSKNTLYLQMNSLRAEDTAVYYCARAATWHDTHLDYWGQGTLVTVSS (SEQ ID NO: 482) | DIQMTQSPSSLSASVGDRVTITCRASQSILSYVNWYQQKPGKAPKLLIYAATSRASGVPSRFSGSGSGTDFTLTISSLQPEDFATYYCQQSYSTPLTFGGGTKVEIK (SEQ ID NO: 553) |
| 368_C07 | EVQLLESGGGLVQPGGSLRLSCAASGFTFSSYGMHWVRQAPGKGLEWVAGINYNSGYTSYADSVKGRFTISRDNSKNTLYLQMNSLRAEDTAVYYCARAATWHDTHLDYWGQGTLVTVSS (SEQ ID NO: 483) | DIQMTQSPSSLSASVGDRVTITCRASQSIVSYVNWYQQKPGKAPKLVIYAATSRASGVPSRFSGSGSGTDFTLTISSLQPEDFATYYCQQSYENPLTFGGGTKVEIK (SEQ ID NO: 554) |
| 368_C12 | EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 484) | DIQMTQSPSSLSASVGDRVTITCRASQSILTYLNWYQQKPGKAPKLLIYAATSRASGVPSRFSGSGSGTDFTLTISSLQPEDFATYYCQQSDSNPLTFGGGTKVEIK (SEQ ID NO: 555) |
| 368_D03 | EVQLLESGGGLVQPGGSLRLSCAASGFTFSDYSMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 485) | DIQMTQSPSSLSASVGDRVTITCRASQSIITYVNWYQQKPGKAPKLLIYATTSRASGVPSRFSGSGSGTDFTLTISSLQPEDFATYYCQQSYDLPLTFGGGTKVEIK (SEQ ID NO: 556) |

TABLE 2B-continued

Group II Antibody Sequences

| Ab | VH sequence | VL sequence |
|---|---|---|
| 368_D06 | EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARAATWHDTHLDYWGQGTLVTVSS (SEQ ID NO: 486) | DIQMTQSPSSLSASVGDRVTITCRASQSILSYVNWYQQKPGKAPKLVIYAATSRHSGVPSRFSGSGSGTDFTLTISSLQPEDFATYYCQQSYENPLTFGGGTKVEIK (SEQ ID NO: 557) |
| 368_D07 | EVQLLESGGGLVQPGGSLRLSCAASGFTFDSYGMHWVRQAPGKGLEWVASINYNGGYTGYADSVKGRFTISRDNSKNTLYLQMNSLRAEDTAVYYCARAATWHDTHLDYWGQGTLVTVSS (SEQ ID NO: 487) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 558) |
| 368_E05 | EVQLLESGGGLVQPGGSLRLSCAASGFTFDSYSMHWVRQAPGKGLEWVSSINYNGGYKSYADSVKGRFTISRDNSKNTLYLQMNSLRAEDTAVYYCARAATWHDTHLDYWGQGTLVTVSS (SEQ ID NO: 488) | DIQMTQSPSSLSASVGDRVTITCRASQSILSYLNWYQQKPGKAPKLVIYAATSRASGVPSRFSGSGSGTDFTLTISSLQPEDFATYYCQQSYSSPLTFGGGTKVEIK (SEQ ID NO: 559) |
| 368_E08 | EVQLLESGGGLVQPGGSLRLSCAASGFTFDSYGMNWVRQAPGKGLEWVANINYNSGYTGYADSVKGRFTISRDNSKNTLYLQMNSLRAEDTAVYYCARAATWHDTHLDYWGQGTLVTVSS (SEQ ID NO: 489) | DIQMTQSPSSLSASVGDRVTITCRASQSILSYVNWYQQKPGKAPKLVIYAATSLHSGVPSRFSGSGSGTDFTLTISSLQPEDFATYYCQQSYETPLTFGGGTKVEIK (SEQ ID NO: 560) |
| 368_G11 | EVQLLESGGGLVQPGGSLRLSCAASGFTFDSYGMHWVRQAPGKGLEWVSGINYNSGYKSYADSVKGRFTISRDNSKNTLYLQMNSLRAEDTAVYYCARAATWHDTALDYWGQGTLVTVSS (SEQ ID NO: 490) | DIQMTQSPSSLSASVGDRVTITCRASQSILTYLNWYQQKPGKAPKLLIYAATSRASGVPSRFSGSGSGTDFTLTISSLQPEDFATYYCQQSDNTPLTFGGGTKVEIK (SEQ ID NO: 561) |
| 368_H03 | EVQLLESGGGLVQPGGSLRLSCAASGFTFDDYSMHWVRQAPGKGLEWVASINYNGGYTGYADSVKGRFTISRDNSKNTLYLQMNSLRAEDTAVYYCARAATWHDTHLDYWGQGTLVTVSS (SEQ ID NO: 491) | DIQMTQSPSSLSASVGDRVTITCRASQSILSYVNWYQQKPGKAPKLVIYAVTSRHSGVPSRFSGSGSGTDFTLTISSLQPEDFATYYCQQSYSNPLTFGGGTKVEIK (SEQ ID NO: 562) |
| 369_A04 | EVQLLESGGGLVQPGGSLRLSCAASGFTFDSYGMHWVRQAPGKGLEWVASINYNGGYKSYADSVKGRFTISRDNSKNTLYLQMNSLRAEDTAVYYCARAATWHDTHLDYWGQGTLVTVSS (SEQ ID NO: 492) | DIQMTQSPSSLSASVGDRVTITCRASQSIVSYVNWYQQKPGKAPKLVIYAATSLASGVPSRFSGSGSGTDFTLTISSLQPEDFATYYCQQSYDLPLTFGGGTKVEIK (SEQ ID NO: 563) |
| 369_A12 | EVQLLESGGGLVQPGGSLRLSCAASGFTFSSYSMHWVRQAPGKGLEWVASINYNSGYTGYADSVKGRFTISRDNSKNTLYLQMNSLRAEDTAVYYCARAATWHDTHLDYWGQGTLVTVSS (SEQ ID NO: 493) | DIQMTQSPSSLSASVGDRVTITCRASQSILTYLNWYQQKPGKAPKLLIYAATSRHSGVPSRFSGSGSGTDFTLTISSLQPEDFATYYCQQSYDLPLTFGGGTKVEIK (SEQ ID NO: 564) |
| 369_B07 | EVQLLESGGGLVQPGGSLRLSCAASGFTFDSYGMHWVRQAPGKGLEWVANINYNGGYKSYADSVKGRFTISRDNSKNTLYLQMNSLRAEDTAVYYCARAATWHDTHLDYWGQGTLVTVSS (SEQ ID NO: 494) | DIQMTQSPSSLSASVGDRVTITCRASQSIVSYVNWYQQKPGKAPKLVIYAATSLASGVPSRFSGSGSGTDFTLTISSLQPEDFATYYCQQSYDLPLTFGGGTKVEIK (SEQ ID NO: 565) |
| 369_B08 | EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAATWHDTHLDYWGQGTLVTVSS (SEQ ID NO: 495) | DIQMTQSPSSLSASVGDRVTITCRASQSILSYVNWYQQKPGKAPKLLIYAATSRASGVPSRFSGSGSGTDFTLTISSLQPEDFATYYCQQSYESPLTFGGGTKVEIK (SEQ ID NO: 566) |
| 369_C06 | EVQLLESGGGLVQPGGSLRLSCAASGFTFSSYSMHWVRQAPGKGLEWVSSINYNGGYKSYADSVKGRFTISRDNSKNTLYLQMNSLRAEDTAVYYCARAATWHDTHLDYWGQGTLVTVSS (SEQ ID NO: 496) | DIQMTQSPSSLSASVGDRVTITCRASQSILSYVNWYQQKPGKAPKLLIYAATSRASGVPSRFSGSGSGTDFTLTISSLQPEDFATYYCQQSYDSPLTFGGGTKVEIK (SEQ ID NO: 567) |
| 369_C09 | EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARAATWHDTHLDYWGQGTLVTVSS (SEQ ID NO: 497) | DIQMTQSPSSLSASVGDRVTITCRASQSIVSYLNWYQQKPGKAPKLVIYAATSRHSGVPSRFSGSGSGTDFTLTISSLQPEDFATYYCQQSYDLPLTFGGGTKVEIK (SEQ ID NO: 568) |

TABLE 2B-continued

Group II Antibody Sequences

| Ab | VH sequence | VL sequence |
|---|---|---|
| 369_C11 | EVQLLESGGGLVQPGGSLRLSCAASGFTFSDYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 498) | DIQMTQSPSSLSASVGDRVTITCRASQSILSYLNWYQQKPGKAPKLVIYAATSRASGVPSRFSGSGSGTDFTLTISSLQPEDFATYYCQQSYDTPLTFGGGTKVEIK (SEQ ID NO: 569) |
| 369_E03 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 499) | DIQMTQSPSSLSASVGDRVTITCRASQSILSYVNWYQQKPGKAPKLLIYAATSLASGVPSRFSGSGSGTDFTLTISSLQPEDFATYYCQQSYENPLTFGGGTKVEIK (SEQ ID NO: 570) |
| 370_B06 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 500) | DIQMTQSPSSLSASVGDRVTITCRASQSIVSYVNWYQQKPGKAPKLVIYAATSRASGVPSRFSGSGSGTDFTLTISSLQPEDFATYYCQQSYETPLTFGGGTKVEIK (SEQ ID NO: 571) |
| 370_B07 | EVQLLESGGGLVQPGGSLRLSCAASGFTFSSYGMHWVRQAPGKGLEWVANINYNSGYKSYADSVKGRFTISRDNSKNTLYLQMNSLRAEDTAVYYCARAATWHDTHLDYWGQGTLVTVSS (SEQ ID NO: 501) | DIQMTQSPSSLSASVGDRVTITCRASQSILTYVNWYQQKPGKAPKLLIYAATSRHSGVPSRFSGSGSGTDFTLTISSLQPEDFATYYCQQSYSSPLTFGGGTKVEIK (SEQ ID NO: 572) |
| 370_E12 | EVQLLESGGGLVQPGGSLRLSCAASGFTFDSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 502) | DIQMTQSPSSLSASVGDRVTITCRASQSILSYVNWYQQKPGKAPKLLIYAATSRASGVPSRFSGSGSGTDFTLTISSLQPEDFATYYCQQSYENPLTFGGGTKVEIK (SEQ ID NO: 573) |
| 370_H05 | EVQLLESGGGLVQPGGSLRLSCAASGFTFSSYGMHWVRQAPGKGLEWVSNINYNGGYTSYADSVKGRFTISRDNSKNTLYLQMNSLRAEDTAVYYCARAATWHDTHLDYWGQGTLVTVSS (SEQ ID NO: 503) | DIQMTQSPSSLSASVGDRVTITCRASQSILSYLNWYQQKPGKAPKLLIYAASSLQSGVPSRFSGSGSGTDFTLTISSLQPEDFATYYCQQSDSLPLTFGGGTKVEIK (SEQ ID NO: 574) |
| 371_A05 | EVQLLESGGGLVQPGGSLRLSCAASGFTFSSYGMHWVRQAPGKGLEWVSNINYNGGYKSYADSVKGRFTISRDNSKNTLYLQMNSLRAEDTAVYYCARAATWHDTHLDYWGQGTLVTVSS (SEQ ID NO: 504) | DIQMTQSPSSLSASVGDRVTITCRASQSILTYLNWYQQKPGKAPKLLIYAATSRASGVPSRFSGSGSGTDFTLTISSLQPEDFATYYCQQSDNLPLTFGGGTKVEIK (SEQ ID NO: 575) |
| 371_B02 | EVQLLESGGGLVQPGGSLRLSCAASGFTFDSYGMNWVRQAPGKGLEWVSNINYNGGYTSYADSVKGRFTISRDNSKNTLYLQMNSLRAEDTAVYYCARAATWHDTHLDYWGQGTLVTVSS (SEQ ID NO: 505) | DIQMTQSPSSLSASVGDRVTITCRASQSILTYVNWYQQKPGKAPKLVIYAATSLASGVPSRFSGSGSGTDFTLTISSLQPEDFATYYCQQSYNNPLTFGGGTKVEIK (SEQ ID NO: 576) |
| 371_B11 | EVQLLESGGGLVQPGGSLRLSCAASGFTFSSYSMHWVRQAPGKGLEWVASINYNSGYTSYADSVKGRFTISRDNSKNTLYLQMNSLRAEDTAVYYCARAATWHDTHLDYWGQGTLVTVSS (SEQ ID NO: 506) | DIQMTQSPSSLSASVGDRVTITCRASQSILTYLNWYQQKPGKAPKLLIYAATSRASGVPSRFSGSGSGTDFTLTISSLQPEDFATYYCQQSYELPLTFGGGTKVEIK (SEQ ID NO: 577) |
| 371_C02 | EVQLLESGGGLVQPGGSLRLSCAASGFTFDSYGMHWVRQAPGKGLEWVAGINYNSGYTGYADSVKGRFTISRDNSKNTLYLQMNSLRAEDTAVYYCARAATWHDTHLDYWGQGTLVTVSS (SEQ ID NO: 507) | DIQMTQSPSSLSASVGDRVTITCRASQSILTYVNWYQQKPGKAPKLLIYAASSLQSGVPSRFSGSGSGTDFTLTISSLQPEDFATYYCQQSYDTPLTFGGGTKVEIK (SEQ ID NO: 578) |
| 371_D05 | EVQLLESGGGLVQPGGSLRLSCAASGFTFDDYGMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 508) | DIQMTQSPSSLSASVGDRVTITCRASQSILTYLNWYQQKPGKAPKLLIYAASSLQSGVPSRFSGSGSGTDFTLTISSLQPEDFATYYCQQSYDSPLTFGGGTKVEIK (SEQ ID NO: 579) |
| 371_F07 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 509) | DIQMTQSPSSLSASVGDRVTITCRASQSILTYLNWYQQKPGKAPKLLIYAATSLASGVPSRFSGSGSGTDFTLTISSLQPEDFATYYCQQSDSNPLTFGGGTKVEIK (SEQ ID NO: 580) |

TABLE 2B-continued

Group II Antibody Sequences

| Ab | VH sequence | VL sequence |
|---|---|---|
| 371_G07 | EVQLLESGGGLVQPGGSLRLSCAASGFTFSDYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 510) | DIQMTQSPSSLSASVGDRVTITCRASQSIVSYVNWYQQKPGKAPKLVIYAATSRASGVPSRFSGSGSGTDFTLTISSLQPEDFATYYCQQSYSLPLTFGGGTKVEIK (SEQ ID NO: 581) |
| 372_D07 | EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 511) | DIQMTQSPSSLSASVGDRVTITCRASQSILSYLNWYQQKPGKAPKLLIYAATSRASGVPSRFSGSGSGTDFTLTISSLQPEDFATYYCQQSYESPLTFGGGTKVEIK (SEQ ID NO: 582) |
| 373_B01 | EVQLLESGGGLVQPGGSLRLSCAASGFTFDSYGMHWVRQAPGKGLEWVSGINYNGGYKSYADSVKGRFTISRDNSKNTLYLQMNSLRAEDTAVYYCARAATWHDTHLDYWGQGTLVTVSS (SEQ ID NO: 512) | DIQMTQSPSSLSASVGDRVTITCRASQSILSYVNWYQQKPGKAPKLVIYAATSRASGVPSRFSGSGSGTDFTLTISSLQPEDFATYYCQQSYDLPLTFGGGTKVEIK (SEQ ID NO: 583) |
| 373_D11 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAATWHDTHLDYWGQGTLVTVSS (SEQ ID NO: 513) | DIQMTQSPSSLSASVGDRVTITCRASQSILTYVNWYQQKPGKAPKLLIYAATSRASGVPSRFSGSGSGTDFTLTISSLQPEDFATYYCQQSYDNPLTFGGGTKVEIK (SEQ ID NO: 584) |
| 373_G06 | EVQLLESGGGLVQPGGSLRLSCAASGFTFSSYGMHWVRQAPGKGLEWVASINYNSGYTGYADSVKGRFTISRDNSKNTLYLQMNSLRAEDTAVYYCARAATWHDTHLDYWGQGTLVTVSS (SEQ ID NO: 514) | DIQMTQSPSSLSASVGDRVTITCRASQSILSYVNWYQQKPGKAPKLLIYAATSLASGVPSRFSGSGSGTDFTLTISSLQPEDFATYYCQQSYNLPLTFGGGTKVEIK (SEQ ID NO: 585) |
| 374_A10 | EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 515) | DIQMTQSPSSLSASVGDRVTITCRASQSILSYVNWYQQKPGKAPKLLIYAATSRASGVPSRFSGSGSGTDFTLTISSLQPEDFATYYCQQSYDTPLTFGGGTKVEIK (SEQ ID NO: 586) |
| 374_A12 | EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAATWHDTHLDYWGQGTLVTVSS (SEQ ID NO: 516) | DIQMTQSPSSLSASVGDRVTITCRASQSILTYLNWYQQKPGKAPKLLIYAATSRASGVPSRFSGSGSGTDFTLTISSLQPEDFATYYCQQSDSNPLTFGGGTKVEIK (SEQ ID NO: 587) |
| 374_B01 | EVQLLESGGGLVQPGGSLRLSCAASGFTFDSYGMHWVRQAPGKGLEWVAGINYNSGYTSYADSVKGRFTISRDNSKNTLYLQMNSLRAEDTAVYYCARAATWHDTHLDYWGQGTLVTVSS (SEQ ID NO: 517) | DIQMTQSPSSLSASVGDRVTITCRASQSILSYLNWYQQKPGKAPKLLIYAASSLQSGVPSRFSGSGSGTDFTLTISSLQPEDFATYYCQQSYDSPLTFGGGTKVEIK (SEQ ID NO: 588) |
| 374_B07 | EVQLLESGGGLVQPGGSLRLSCAASGFTFSSYGMHWVRQAPGKGLEWVSSINYNGGYKSYADSVKGRFTISRDNSKNTLYLQMNSLRAEDTAVYYCARAATWHDTHLDYWGQGTLVTVSS (SEQ ID NO: 518) | DIQMTQSPSSLSASVGDRVTITCRASQSIISYLNWYQQKPGKAPKLLIYAATSLASGVPSRFSGSGSGTDFTLTISSLQPEDFATYYCQQSYESPLTFGGGTKVEIK (SEQ ID NO: 589) |
| 374_H02 | EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 519) | DIQMTQSPSSLSASVGDRVTITCRASQSILSYVNWYQQKPGKAPKLLIYAATSLASGVPSRFSGSGSGTDFTLTISSLQPEDFATYYCQQSYDTPLTFGGGTKVEIK (SEQ ID NO: 590) |
| 375_C03 | EVQLLESGGGLVQPGGSLRLSCAASGFTFDSYSMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 520) | DIQMTQSPSSLSASVGDRVTITCRASQSILSYVNWYQQKPGKAPKLVIYAATSRASGVPSRFSGSGSGTDFTLTISSLQPEDFATYYCQQSYESPLTFGGGTKVEIK (SEQ ID NO: 591) |
| 375_C05 | EVQLLESGGGLVQPGGSLRLSCAASGFTFXSYGMNWVRQAPGKGLEWVASINYNGGYKGYADSVKGRFTISRDNSKNTLYLQMNSLRAEDTAVYYCARAATWHDTHLDYWGQGTLVTVSS (SEQ ID NO: 521) | DIQMTQSPSSLSASVGDRVTITCRASQSILSYLNWYQQKPGKAPKLLIYAATSRASGVPSRFSGSGSGTDFTLTISSLQPEDFATYYCQQSYELPLTFGGGTKVEIK (SEQ ID NO: 592) |

TABLE 2B-continued

Group II Antibody Sequences

| Ab | VH sequence | VL sequence |
|---|---|---|
| 375_D02 | EVQLLESGGGLVQPGGSLRLSCAASGFTFSSYSMNWVRQAPGKGLEWVSNINYNGGYTSYADSVKGRFTISRDNSKNTLYLQMNSLRAEDTAVYYCARAATWHDTHLDYWGQGTLVTVSS (SEQ ID NO: 522) | DIQMTQSPSSLSASVGDRVTITCRASQSILTYLNWYQQKPGKAPKLLIYAASSLQSGVPSRFSGSGSGTDFTLTISSLQPEDFATYYCQQSYELPLTFGGGTKVEIK (SEQ ID NO: 593) |
| 375_G08 | EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARAATWHDTHLDYWGQGTLVTVSS (SEQ ID NO: 523) | DIQMTQSPSSLSASVGDRVTITCRASQSISSYVNWYQQKPGKAPKLLIYAVTSRASGVPSRFSGSGSGTDFTLTISSLQPEDFATYYCQQSYSTPLTFGGGTKVEIK (SEQ ID NO: 594) |
| 375_H04 | EVQLLESGGGLVQPGGSLRLSCAASGFTFSSYGMHWVRQAPGKGLEWVAGINYNSGYTGYADSVKGRFTISRDNSKNTLYLQMNSLRAEDTAVYYCARAATWHDTHLDYWGQGTLVTVSS (SEQ ID NO: 524) | DIQMTQSPSSLSASVGDRVTITCRASQSILSYLNWYQQKPGKAPKLVIYAATSRASGVPSRFSGSGSGTDFTLTISSLQPEDFATYYCQQSYSNPLTFGGGTKVEIK (SEQ ID NO: 595) |
| 376_D08 | EVQLLESGGGLVQPGGSLRLSCAASGFTFDSYGMNWVRQAPGKGLEWVANINYNSGYKSYADSVKGRFTISRDNSKNTLYLQMNSLRAEDTAVYYCARAATWHDTALDYWGQGTLVTVSS (SEQ ID NO: 525) | DIQMTQSPSSLSASVGDRVTITCRASQSILTYLNWYQQKPGKAPKLVIYYANNRPSGVPSRFSGSGSGTDFTLTISSLQPEDFATYYCQQSYSNPLTFGGGTKVEIK (SEQ ID NO: 596) |
| 376_F09 | EVQLLESGGGLVQPGGSLRLSCAASGFTFDSYSMHWVRQAPGKGLEWVSSINYNGGYKSYADSVKGRFTISRDNSKNTLYLQMNSLRAEDTAVYYCARAATWHDTHLDYWGQGTLVTVSS (SEQ ID NO: 526) | DIQMTQSPSSLSASVGDRVTITCRASQSILTYVNWYQQKPGKAPKLLIYAVTSRASGVPSRFSGSGSGTDFTLTISSLQPEDFATYYCQQSYDTPLTFGGGTKVEIK (SEQ ID NO: 597) |
| 376_H12 | EVQLLESGGGLVQPGGSLRLSCAASGFTFSDYGMHWVRQAPGKGLEWVASINYNGGYTSYADSVKGRFTISRDNSKNTLYLQMNSLRAEDTAVYYCARAATWHDTHLDYWGQGTLVTVSS (SEQ ID NO: 527) | DIQMTQSPSSLSASVGDRVTITCRASQSIITYLNWYQQKPGKAPKLVIYAATSRASGVPSRFSGSGSGTDFTLTISSLQPEDFATYYCQQSYESPLTFGGGTKVEIK (SEQ ID NO: 598) |

Table 3B provides the amino acid sequences of the CDRs of the antibodies shown in Table 2B.

TABLE 3B

CDR sequences for Group II antibodies

| Ab | HCDR1 | HCDR2 | HCDR3 | LCDR1 | LCDR2 | LCDR3 |
|---|---|---|---|---|---|---|
| 365_A05 | SSYGMH (SEQ ID NO: 599) | WVSSINYNGGYTS (SEQ ID NO: 670) | ARAATWHDTHLD (SEQ ID NO: 742) | SSYLNWY (SEQ ID NO: 813) | LLIYAASSLQ (SEQ ID NO: 884) | QQSYSTPL (SEQ ID NO: 955) |
| 365_B08 | DSYGMN (SEQ ID NO: 600) | WVSNINYNSGYKG (SEQ ID NO: 671) | ARAATWHDTHLD (SEQ ID NO: 743) | VTYLNWY (SEQ ID NO: 814) | LLIYAATSRA (SEQ ID NO: 885) | QQSYSSPL (SEQ ID NO: 956) |
| 365_B12 | SDYGMH (SEQ ID NO: 601) | WVSGINYNGGYTS (SEQ ID NO: 672) | ARAATWHDTHLD (SEQ ID NO: 744) | STYVNWY (SEQ ID NO: 815) | LLIYAVTSLH (SEQ ID NO: 886) | QQSYDNPL (SEQ ID NO: 957) |
| 365_D03 | DDYSMH (SEQ ID NO: 602) | WVASINYNGGYKS (SEQ ID NO: 673) | ARAATWHDTHLD (SEQ ID NO: 745) | VSYLNWY (SEQ ID NO: 816) | LVIYAATSRA (SEQ ID NO: 887) | QQSYDSPL (SEQ ID NO: 958) |
| 365_D08 | DSYSMH (SEQ ID NO: 603) | WVSSINYNGGYTS (SEQ ID NO: 674) | ARAATWHDTHLD (SEQ ID NO: 746) | ITYVNWY (SEQ ID NO: 817) | LLIYAATSRA (SEQ ID NO: 888) | QQSYDTPL (SEQ ID NO: 959) |

TABLE 3B-continued

CDR sequences for Group II antibodies

| Ab | HCDR1 | HCDR2 | HCDR3 | LCDR1 | LCDR2 | LCDR3 |
|---|---|---|---|---|---|---|
| 365_E06 | DSYGMN (SEQ ID NO: 604) | WVSGINYNGGYTG (SEQ ID NO: 675) | ARAATWHDTHLD (SEQ ID NO: 747) | LTYLNWY (SEQ ID NO: 818) | LVIYAATSRA (SEQ ID NO: 889) | QQSYNTPL (SEQ ID NO: 960) |
| 365_F10 | DDYGMH (SEQ ID NO: 605) | WVSGINYNGGYTS (SEQ ID NO: 676) | ARAATWHDTHLD (SEQ ID NO: 748) | VTYVNWY (SEQ ID NO: 819) | LLIYAATSRA (SEQ ID NO: 890) | QQSYELPL (SEQ ID NO: 961) |
| 365_G06 | DSYGMH (SEQ ID NO: 606) | WVAGINYNGGYTS (SEQ ID NO: 677) | ARAATWHDTHLD (SEQ ID NO: 749) | LSYLNWY (SEQ ID NO: 820) | LLIYAATSLA (SEQ ID NO: 891) | QQSDSTPL (SEQ ID NO: 962) |
| 365_G08 | SSYGMH (SEQ ID NO: 607) | WVASINYNGGYTS (SEQ ID NO: 678) | ARAATWHDTHLD (SEQ ID NO: 750) | SSYLNWY (SEQ ID NO: 821) | LLIYAASSLQ (SEQ ID NO: 892) | QQSYETPL (SEQ ID NO: 963) |
| 366_B09 | SDYGMH (SEQ ID NO: 608) | WVSSINYNSGYKS (SEQ ID NO: 679) | ARAATWHDTHLD (SEQ ID NO: 751) | LTYLNWY (SEQ ID NO: 822) | LVIYAATSRH (SEQ ID NO: 893) | QQSYDSPL (SEQ ID NO: 964) |
| 366_C05 | DDYGMH (SEQ ID NO: 609) | WVSSINYNGGYTG (SEQ ID NO: 680) | ARAATWHDTHLD (SEQ ID NO: 752) | ISYLNWY (SEQ ID NO: 823) | LVIYAATSRA (SEQ ID NO: 894) | QQSYDSPL (SEQ ID NO: 965) |
| 366_E07 | DSYGMH (SEQ ID NO: 610) | WVAGINYNGGYTS (SEQ ID NO: 681) | ARAATWHDTALD (SEQ ID NO: 753) | LTYLNWY (SEQ ID NO: 824) | LVIYAATSRH (SEQ ID NO: 895) | QQSDNSPL (SEQ ID NO: 966) |
| 366_G02 | DSYGMH (SEQ ID NO: 611) | WVSSINYNGGYTS (SEQ ID NO: 682) | ARAATWHDTHLD (SEQ ID NO: 754) | LTYLNWY (SEQ ID NO: 825) | LLIYAATSRH (SEQ ID NO: 896) | QQSDDNPL (SEQ ID NO: 967) |
| 366_H01 | DDYSMH (SEQ ID NO: 612) | WVANINYNGGYTS (SEQ ID NO: 683) | ARAATWHDTHLD (SEQ ID NO: 755) | LTYLNWY (SEQ ID NO: 826) | LVIYATTSRH (SEQ ID NO: 897) | QQSYESPL (SEQ ID NO: 968) |
| 367_C06 | DSYSMH (SEQ ID NO: 613) | WVASINYNGGYKS (SEQ ID NO: 684) | ARAATWHDTHLD (SEQ ID NO: 756) | LTYLNWY (SEQ ID NO: 827) | LVIYAATSLH (SEQ ID NO: 898) | QQSYDTPL (SEQ ID NO: 969) |
| 367_C12 | SSYGMH (SEQ ID NO: 614) | WVSGINYNGGYTS (SEQ ID NO: 685) | ARAATWHDTHLD (SEQ ID NO: 757) | LSYVNWY (SEQ ID NO: 828) | LLIYATTSRH (SEQ ID NO: 899) | QQSYESPL (SEQ ID NO: 970) |
| 367_E08 | SDYGMN (SEQ ID NO: 615) | WVASINYNGGYTS (SEQ ID NO: 686) | ARAATWHDTHLD (SEQ ID NO: 758) | LSYLNWY (SEQ ID NO: 829) | LLIYATTSRA (SEQ ID NO: 900) | QQSYDNPL (SEQ ID NO: 971) |
| 367_E10 | SSYGMH (SEQ ID NO: 616) | WVSSINYNGGYTG (SEQ ID NO: 687) | ARAATWHDTHLD (SEQ ID NO: 759) | LSYVNWY (SEQ ID NO: 830) | LLIYAATSRA (SEQ ID NO: 901) | QQSYELPL (SEQ ID NO: 972) |
| 367_F08 | SSYGMH (SEQ ID NO: 617) | WVSSINYNSGYTS (SEQ ID NO: 688) | ARAATWHDTHLD (SEQ ID NO: 760) | LSYVNWY (SEQ ID NO: 831) | LVIYAATSRA (SEQ ID NO: 902) | QQSNELPL (SEQ ID NO: 973) |
| 367_F10 | DSYGMN (SEQ ID NO: 618) | WVSGINYNSGYTS (SEQ ID NO: 689) | ARAATWHDTHLD (SEQ ID NO: 761) | LTYLNWY (SEQ ID NO: 832) | LLIYAATSRA (SEQ ID NO: 903) | QQSYDTPL (SEQ ID NO: 974) |

TABLE 3B-continued

CDR sequences for Group II antibodies

| Ab | HCDR1 | HCDR2 | HCDR3 | LCDR1 | LCDR2 | LCDR3 |
|---|---|---|---|---|---|---|
| 367_G03 | DSYSMH (SEQ ID NO: 619) | WVANINYNGGYTS (SEQ ID NO: 690) | ARAATWHDTHLD (SEQ ID NO: 762) | VSYVNWY (SEQ ID NO: 833) | LVIYAATSRH (SEQ ID NO: 904) | QQSYDLPL (SEQ ID NO: 975) |
| 367_G11 | SSYGMH (SEQ ID NO: 620) | WVASINYNGGYTS (SEQ ID NO: 691) | ARAATWHDTHLD (SEQ ID NO: 763) | LTYLNWY (SEQ ID NO: 834) | LLIYAATSRH (SEQ ID NO: 905) | QQSDDSPL (SEQ ID NO: 976) |
| 367_H08 | DSYGMN (SEQ ID NO: 621) | WVSSINYNGGYTS (SEQ ID NO: 692) | ARAATWHDTHLD (SEQ ID NO: 764) | LTYVNWY (SEQ ID NO: 835) | LLIYAATSRH (SEQ ID NO: 906) | QQSYNLPL (SEQ ID NO: 977) |
| 368_B04 | DSYGMH (SEQ ID NO: 622) | WVSSINYNGGYTS (SEQ ID NO: 693) | ARAATWHDTHLD (SEQ ID NO: 765) | VSYLNWY (SEQ ID NO: 836) | LVIYAATSRA (SEQ ID NO: 907) | QQSYENPL (SEQ ID NO: 978) |
| 368_B12 | DSYGMH (SEQ ID NO: 623) | WVSGINYNSGYTS (SEQ ID NO: 694) | ARAATWHDTHLD (SEQ ID NO: 766) | VSYVNWY (SEQ ID NO: 837) | LLIYAATSRA (SEQ ID NO: 908) | QQSYDLPL (SEQ ID NO: 979) |
| 368_C04 | DSYGMH (SEQ ID NO: 624) | WVSNINYNGGYTS (SEQ ID NO: 695) | ARAATWHDTHLD (SEQ ID NO: 767) | LSYVNWY (SEQ ID NO: 838) | LLIYAATSRA (SEQ ID NO: 909) | QQSYSTPL (SEQ ID NO: 980) |
| 368_C07 | SSYGMH (SEQ ID NO: 625) | WVAGINYNSGYTS (SEQ ID NO: 696) | ARAATWHDTHLD (SEQ ID NO: 768) | VSYVNWY (SEQ ID NO: 839) | LVIYAATSRA (SEQ ID NO: 910) | QQSYENPL (SEQ ID NO: 981) |
| 368_C12 | DSYGMH (SEQ ID NO: 626) | WVASINYNGGYTS (SEQ ID NO: 697) | ARAATWHDTHLD (SEQ ID NO: 769) | LTYLNWY (SEQ ID NO: 840) | LLIYAATSRA (SEQ ID NO: 911) | QQSDSNPL (SEQ ID NO: 982) |
| 368_D03 | SDYSMH (SEQ ID NO: 627) | WVASINYNGGYTS (SEQ ID NO: 698) | ARAATWHDTHLD (SEQ ID NO: 770) | ITYVNWY (SEQ ID NO: 841) | LLIYATTSRA (SEQ ID NO: 912) | QQSYDLPL (SEQ ID NO: 983) |
| 368_D06 | SSYGMN (SEQ ID NO: 628) | WVSNINYNGGYTG (SEQ ID NO: 699) | ARAATWHDTHLD (SEQ ID NO: 771) | LSYVNWY (SEQ ID NO: 842) | LVIYAATSRH (SEQ ID NO: 913) | QQSYENPL (SEQ ID NO: 984) |
| 368_D07 | DSYGMH (SEQ ID NO: 629) | WVASINYNGGYTG (SEQ ID NO: 700) | ARAATWHDTHLD (SEQ ID NO: 772) | SSYLNWY (SEQ ID NO: 843) | LLIYAASSLQ (SEQ ID NO: 914) | QQSYSTPL (SEQ ID NO: 985) |
| 368_E05 | DSYSMH (SEQ ID NO: 630) | WVSSINYNGGYKS (SEQ ID NO: 701) | ARAATWHDTHLD (SEQ ID NO: 773) | LSYLNWY (SEQ ID NO: 844) | LVIYAATSRA (SEQ ID NO: 915) | QQSYSSPL (SEQ ID NO: 986) |
| 368_E08 | DSYGMH (SEQ ID NO: 631) | WVANINYNSGYTG (SEQ ID NO: 702) | ARAATWHDTHLD (SEQ ID NO: 774) | LSYVNWY (SEQ ID NO: 845) | LVIYAATSLH (SEQ ID NO: 916) | QQSYETPL (SEQ ID NO: 987) |
| 368_G11 | DSYGMH (SEQ ID NO: 632) | WVSGINYNSGYKS (SEQ ID NO: 703) | ARAATWHDTALD (SEQ ID NO: 775) | LTYLNWY (SEQ ID NO: 846) | LLIYAATSRA (SEQ ID NO: 917) | QQSDNTPL (SEQ ID NO: 988) |
| 368_H03 | DDYSMH (SEQ ID NO: 633) | WVASINYNGGYTG (SEQ ID NO: 704) | ARAATWHDTHLD (SEQ ID NO: 776) | LSYVNWY (SEQ ID NO: 847) | LVIYAVTSRH (SEQ ID NO: 918) | QQSYSNPL (SEQ ID NO: 989) |

TABLE 3B-continued

CDR sequences for Group II antibodies

| Ab | HCDR1 | HCDR2 | HCDR3 | LCDR1 | LCDR2 | LCDR3 |
| --- | --- | --- | --- | --- | --- | --- |
| 369_A04 | DSYGMH (SEQ ID NO: 634) | WVASINYNGGYKS (SEQ ID NO: 705) | ARAATWHDTHLD (SEQ ID NO: 777) | VSYVNWY (SEQ ID NO: 848) | LVIYAATSLA (SEQ ID NO: 919) | QQSYDLPL (SEQ ID NO: 990) |
| 369_A12 | SSYSMH (SEQ ID NO: 635) | WVASINYNSGYTG (SEQ ID NO: 706) | ARAATWHDTHLD (SEQ ID NO: 778) | LTYLNWY (SEQ ID NO: 849) | LLIYAATSRH (SEQ ID NO: 920) | QQSYDLPL (SEQ ID NO: 991) |
| 369_B07 | DSYGMH (SEQ ID NO: 636) | WVANINYNGGYKS (SEQ ID NO: 707) | ARAATWHDTHLD (SEQ ID NO: 779) | VSYVNWY (SEQ ID NO: 850) | LVIYAATSLA (SEQ ID NO: 921) | QQSYDLPL (SEQ ID NO: 992) |
| 369_B08 | DSYGMH (SEQ ID NO: 637) | WVSSINYNGGYTS (SEQ ID NO: 708) | ARAATWHDTHLD (SEQ ID NO: 780) | LSYVNWY (SEQ ID NO: 851) | LLIYAATSRA (SEQ ID NO: 922) | QQSYESPL (SEQ ID NO: 993) |
| 369_C06 | SSYSMH (SEQ ID NO: 638) | WVSSINYNGGYKS (SEQ ID NO: 709) | ARAATWHDTHLD (SEQ ID NO: 781) | LSYVNWY (SEQ ID NO: 852) | LLIYAATSRA (SEQ ID NO: 923) | QQSYDSPL (SEQ ID NO: 994) |
| 369_C09 | SSYGMH (SEQ ID NO: 639) | WVSSINYNGGYTG (SEQ ID NO: 710) | ARAATWHDTHLD (SEQ ID NO: 782) | VSYLNWY (SEQ ID NO: 853) | LVIYAATSRH (SEQ ID NO: 924) | QQSYDLPL (SEQ ID NO: 995) |
| 369_C11 | SDYGMH (SEQ ID NO: 640) | WVAGINYNGGYTG (SEQ ID NO: 711) | ARAATWHDTHLD (SEQ ID NO: 783) | LSYLNWY (SEQ ID NO: 854) | LVIYAATSRA (SEQ ID NO: 925) | QQSYDTPL (SEQ ID NO: 996) |
| 369_E03 | SSYGMH (SEQ ID NO: 641) | WVAGINYNGGYTS (SEQ ID NO: 712) | ARAATWHDTHLD (SEQ ID NO: 784) | LSYVNWY (SEQ ID NO: 855) | LLIYAATSLA (SEQ ID NO: 926) | QQSYENPL (SEQ ID NO: 997) |
| 370_B06 | SSYGMH (SEQ ID NO: 642) | WVAGINYNGGYTS (SEQ ID NO: 713) | ARAATWHDTHLD (SEQ ID NO: 785) | VSYVNWY (SEQ ID NO: 856) | LVIYAATSRA (SEQ ID NO: 927) | QQSYETPL (SEQ ID NO: 998) |
| 370_B07 | SSYGMH (SEQ ID NO: 643) | WVANINYNSGYKS (SEQ ID NO: 714) | ARAATWHDTHLD (SEQ ID NO: 786) | LTYVNWY (SEQ ID NO: 857) | LLIYAATSRH (SEQ ID NO: 928) | QQSYSSPL (SEQ ID NO: 999) |
| 370_E12 | DSYGMH (SEQ ID NO: 644) | WVAGINYNGGYTS (SEQ ID NO: 715) | ARAATWHDTHLD (SEQ ID NO: 787) | LSYVNWY (SEQ ID NO: 858) | LLIYAATSRA (SEQ ID NO: 929) | QQSYENPL (SEQ ID NO: 1000) |
| 370_H05 | SSYGMH (SEQ ID NO: 645) | WVSNINYNGGYTS (SEQ ID NO: 716) | ARAATWHDTHLD (SEQ ID NO: 788) | LSYLNWY (SEQ ID NO: 859) | LLIYAASSLQ (SEQ ID NO: 930) | QQSDSLPL (SEQ ID NO: 1001) |
| 371_A05 | SSYGMH (SEQ ID NO: 646) | WVSNINYNGGYKS (SEQ ID NO: 717) | ARAATWHDTHLD (SEQ ID NO: 789) | LTYLNWY (SEQ ID NO: 860) | LLIYAATSRA (SEQ ID NO: 931) | QQSDNLPL (SEQ ID NO: 1002) |
| 371_B02 | DSYGMN (SEQ ID NO: 647) | WVSNINYNGGYTS (SEQ ID NO: 718) | ARAATWHDTHLD (SEQ ID NO: 790) | LTYVNWY (SEQ ID NO: 861) | LVIYAATSLA (SEQ ID NO: 932) | QQSYNNPL (SEQ ID NO: 1003) |
| 371_B11 | SSYSMH (SEQ ID NO: 648) | WVASINYNSGYTS (SEQ ID NO: 719) | ARAATWHDTHLD (SEQ ID NO: 791) | LTYLNWY (SEQ ID NO: 862) | LLIYAATSRA (SEQ ID NO: 933) | QQSYELPL (SEQ ID NO: 1004) |

TABLE 3B-continued

CDR sequences for Group II antibodies

| Ab | HCDR1 | HCDR2 | HCDR3 | LCDR1 | LCDR2 | LCDR3 |
|---|---|---|---|---|---|---|
| 371_C02 | DSYGMH (SEQ ID NO: 649) | WVAGINYNSGYTG (SEQ ID NO: 720) | ARAATWHDTHLD (SEQ ID NO: 792) | LTYVNWY (SEQ ID NO: 863) | LLIYAASSLQ (SEQ ID NO: 934) | QQSYDTPL (SEQ ID NO: 1005) |
| 371_D05 | DDYGMH (SEQ ID NO: 650) | WVSGINYNGGYTS (SEQ ID NO: 721) | ARAATWHDTHLD (SEQ ID NO: 793) | LTYLNWY (SEQ ID NO: 864) | LLIYAASSLQ (SEQ ID NO: 935) | QQSYDSPL (SEQ ID NO: 1006) |
| 371_F07 | SSYGMH (SEQ ID NO: 651) | WVAGINYNGGYTS (SEQ ID NO: 722) | ARAATWHDTHLD (SEQ ID NO: 794) | LTYLNWY (SEQ ID NO: 865) | LLIYAATSLA (SEQ ID NO: 936) | QQSDSNPL (SEQ ID NO: 1007) |
| 371_G07 | SDYGMH (SEQ ID NO: 652) | WVAGINYNGGYTS (SEQ ID NO: 723) | ARAATWHDTHLD (SEQ ID NO: 795) | VSYVNWY (SEQ ID NO: 866) | LVIYAATSRA (SEQ ID NO: 937) | QQSYSLPL (SEQ ID NO: 1008) |
| 372_D07 | SSYGMN (SEQ ID NO: 653) | WVAGINYNGGYTS (SEQ ID NO: 724) | ARAATWHDTHLD (SEQ ID NO: 796) | LSYLNWY (SEQ ID NO: 867) | LLIYAATSRA (SEQ ID NO: 938) | QQSYESPL (SEQ ID NO: 1009) |
| 373_B01 | DSYGMH (SEQ ID NO: 654) | WVSGINYNGGYKS (SEQ ID NO: 725) | ARAATWHDTHLD (SEQ ID NO: 797) | LSYVNWY (SEQ ID NO: 868) | LVIYAATSRA (SEQ ID NO: 939) | QQSYDLPL (SEQ ID NO: 1010) |
| 373_D11 | SSYGMH (SEQ ID NO: 655) | WVAGINYNGGYTS (SEQ ID NO: 726) | ARAATWHDTHLD (SEQ ID NO: 798) | LTYVNWY (SEQ ID NO: 869) | LLIYAATSRA (SEQ ID NO: 940) | QQSYDNPL (SEQ ID NO: 1011) |
| 373_G06 | SSYGMH (SEQ ID NO: 656) | WVASINYNSGYTG (SEQ ID NO: 727) | ARAATWHDTHLD (SEQ ID NO: 799) | LSYVNWY (SEQ ID NO: 870) | LLIYAATSLA (SEQ ID NO: 941) | QQSYNLPL (SEQ ID NO: 1012) |
| 374_A10 | SSYGMH (SEQ ID NO: 657) | WVSGINYNGGYTS (SEQ ID NO: 728) | ARAATWHDTHLD (SEQ ID NO: 800) | LSYVNWY (SEQ ID NO: 871) | LLIYAATSRA (SEQ ID NO: 942) | QQSYDTPL (SEQ ID NO: 1013) |
| 374_A12 | DSYGMH (SEQ ID NO: 658) | WVSSINYNGGYTS (SEQ ID NO: 729) | ARAATWHDTHLD (SEQ ID NO: 801) | LTYLNWY (SEQ ID NO: 872) | LLIYAATSRA (SEQ ID NO: 943) | QQSDSNPL (SEQ ID NO: 1014) |
| 374_B01 | DSYGMH (SEQ ID NO: 659) | WVAGINYNSGYTS (SEQ ID NO: 730) | ARAATWHDTHLD (SEQ ID NO: 802) | LSYLNWY (SEQ ID NO: 873) | LLIYAASSLQ (SEQ ID NO: 944) | QQSYDSPL (SEQ ID NO: 1015) |
| 374_B07 | SSYGMH (SEQ ID NO: 660) | WVSSINYNGGYKS (SEQ ID NO: 731) | ARAATWHDTHLD (SEQ ID NO: 803) | ISYLNWY (SEQ ID NO: 874) | LLIYAATSLA (SEQ ID NO: 945) | QQSYESPL (SEQ ID NO: 1016) |
| 374_H02 | SSYGMH (SEQ ID NO: 661) | WVASINYNGGYTS (SEQ ID NO: 732) | ARAATWHDTHLD (SEQ ID NO: 804) | LSYVNWY (SEQ ID NO: 875) | LLIYAATSLA (SEQ ID NO: 946) | QQSYDTPL (SEQ ID NO: 1017) |
| 375_C03 | DSYSMH (SEQ ID NO: 662) | WVSGINYNGGYTS (SEQ ID NO: 733) | ARAATWHDTHLD (SEQ ID NO: 805) | LSYVNWY (SEQ ID NO: 876) | LVIYAATSRA (SEQ ID NO: 947) | QQSYESPL (SEQ ID NO: 1018) |
| 375_C05 | XSYGMN (SEQ ID NO: 663) | WVASINYNGGYKG (SEQ ID NO: 734) | ARAATWHDTHLD (SEQ ID NO: 806) | LSYLNWY (SEQ ID NO: 877) | LLIYAATSRA (SEQ ID NO: 948) | QQSYELPL (SEQ ID NO: 1019) |

TABLE 3B-continued

CDR sequences for Group II antibodies

| Ab | HCDR1 | HCDR2 | HCDR3 | LCDR1 | LCDR2 | LCDR3 |
|---|---|---|---|---|---|---|
| 375_D02 | SSYSMN (SEQ ID NO: 664) | WVSNINYNGGYTS (SEQ ID NO: 735) | ARAATWHDTHLD (SEQ ID NO: 807) | LTYLNWY (SEQ ID NO: 878) | LLIYAASSLQ (SEQ ID NO: 949) | QQSYELPL (SEQ ID NO: 1020) |
| 375_G08 | SSYGMH (SEQ ID NO: 665) | WVSGINYNGGYTS (SEQ ID NO: 736) | ARAATWHDTHLD (SEQ ID NO: 808) | SSYVNWY (SEQ ID NO: 879) | LLIYAVTSRA (SEQ ID NO: 950) | QQSYSTPL (SEQ ID NO: 1021) |
| 375_H04 | SSYGMH (SEQ ID NO: 666) | WVAGINYNSGYTG (SEQ ID NO: 737) | ARAATWHDTHLD (SEQ ID NO: 809) | LSYLNWY (SEQ ID NO: 880) | LVIYAATSRA (SEQ ID NO: 951) | QQSYSNPL (SEQ ID NO: 1022) |
| 376_D08 | DSYGMN (SEQ ID NO: 667) | WVANINYNSGYKS (SEQ ID NO: 738) | ARAATWHDTALD (SEQ ID NO: 810) | LTYLNWY (SEQ ID NO: 881) | LVIYYANNRP (SEQ ID NO: 952) | QQSYSNPL (SEQ ID NO: 1023) |
| 376_F09 | DSYSMH (SEQ ID NO: 668) | WVSSINYNGGYKS (SEQ ID NO: 739) | ARAATWHDTHLD (SEQ ID NO: 811) | LTYVNWY (SEQ ID NO: 882) | LLIYAVTSRA (SEQ ID NO: 953) | QQSYDTPL (SEQ ID NO: 1024) |
| 376_H12 | SDYGMH (SEQ ID NO: 669) | WVASINYNGGYTS (SEQ ID NO: 740) | ARAATWHDTHLD (SEQ ID NO: 812) | ITYLNWY (SEQ ID NO: 883) | LVIYAATSRA (SEQ ID NO: 954) | QQSYESPL (SEQ ID NO: 1025) |

The consensus sequences for each of these CDRs shown in FIG. 3B are as follows:

HCDR1: D/SS/DYG/SMH/N (SEQ ID NO: 6550)

HCDR2: WVA/SS/G/NINYNG/SGYT/KS/G (SEQ ID NO: 6551)

HCDR3: ARAATWHDTH/ALD (SEQ ID NO: 6559)

LCDR1: L/V/I/SS/TYL/VNWY (SEQ ID NO: 6561)

LCDR2: LL/VIYA/YA/T/VT/S/NS/NR/LA/P/Q (SEQ ID NO: 6563)

LCDR3: QQSY/D/ND/E/S/NL/S/T/NPL (SEQ ID NO: 6565)

TABLE 2C

Group III Antibody Sequences

| Ab | VH sequence | VL sequence |
|---|---|---|
| 365_C05 | EVQLLESGGGLVQPGGSLRLSCAASGFTFSDYSMNWVRQAPGKGLEWVSGINYNGGYKGYADSVKGRFTISRDNSKNTLYLQMNSLRAEDTAVYYCARGANWHDTHLDYWGQGTLVTVSS (SEQ ID NO: 1026) | DIQMTQSPSSLSASVGDRVTITCRASQSILTYLNWYQQKPGKAPKLLIYAATSRHSGVPSRFSGSGSGTDFTLTISSLQPEDFATYYCQQSYNSPLTFGGGTKVEIK (SEQ ID NO: 1205) |
| 365_E10 | EVQLLESGGGLVQPGGSLRLSCAASGFTFDSYSMNWVRQAPGKGLEWVSSINYNGYKGYADSVKGRFTISRDNSKNTLYLQMNSLRAEDTAVYYCARGANWHDTHLDYWGQGTLVTVSS (SEQ ID NO: 1027) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 1206) |
| 365_E12 | EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARGANWHDTALDYWGQGTLVTVSS (SEQ ID NO: 1028) | DIQMTQSPSSLSASVGDRVTITCRASQSILTYLNWYQQKPGKAPKLLIYAATSRASGVPSRFSGSGSGTDFTLTISSLQPEDFATYYCQQSYETPLTFGGGTKVEIK (SEQ ID NO: 1207) |
| 365_F02 | EVQLLESGGGLVQPGGSLRLSCAASGFTFSSYSMNWVRQAPGKGLEWVSGINYNGGYKGYADSVKGRFTISRDNSKNTLYLQMNSLRAEDTAVYYCARGANWHDTHLDYWGQGTLVTVSS (SEQ ID NO: 1029) | DIQMTQSPSSLSASVGDRVTITCRASQSILTYVNWYQQKPGKAPKLLIYAATSRHSGVPSRFSGSGSGTDFTLTISSLQPEDFATYYCQQSYDTPLTFGGGTKVEIK (SEQ ID NO: 1208) |

TABLE 2C-continued

Group III Antibody Sequences

| Ab | VH sequence | VL sequence |
|---|---|---|
| 365_F03 | EVQLLESGGGLVQPGGSLRLSCAASGFTFDSYSMNWVRQAPGKGLEWVSSINYNGGYTSYADSVKGRFTISRDNSKNTLYLQMNSLRAEDTAVYYCARGANWHDTHLDYWGQGTLVTVSS (SEQ ID NO: 1030) | DIQMTQSPSSLSASVGDRVTITCRASQSILSYLNWYQQKPGKAPKLLIYAATSRASGVPSRFSGSGSGTDFTLTISSLQPEDFATYYCQQSYDNPLTFGGGTKVEIK (SEQ ID NO: 1209) |
| 365_G03 | EVQLLESGGGLVQPGGSLRLSCAASGFTFSSYGMNWVRQAPGKGLEWVAGINYNSGYKGYADSVKGRFTISRDNSKNTLYLQMNSLRAEDTAVYYCARGANWHDTHLDYWGQGTLVTVSS (SEQ ID NO: 1031) | DIQMTQSPSSLSASVGDRVTITCRASQSIVSYLNWYQQKPGKAPKLLIYAATSRASGVPSRFSGSGSGTDFTLTISSLQPEDFATYYCQQSYNTPLTFGGGTKVEIK (SEQ ID NO: 1210) |
| 365_G04 | EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARGANWHDTHLDYWGQGTLVTVSS (SEQ ID NO: 1032) | DIQMTQSPSSLSASVGDRVTITCRASQSIVSYVNWYQQKPGKAPKLVIYAATSLASGVPSRFSGSGSGTDFTLTISSLQPEDFATYYCQQSYDTPLTFGGGTKVEIK (SEQ ID NO: 1211) |
| 365_G05 | EVQLLESGGGLVQPGGSLRLSCAASGFTFSSYGMNWVRQAPGKGLEWVSGINYNGGYKGYADSVKGRFTISRDNSKNTLYLQMNSLRAEDTAVYYCARGANWHDTALDYWGQGTLVTVSS (SEQ ID NO: 1033) | DIQMTQSPSSLSASVGDRVTITCRASQSILSYLNWYQQKPGKAPKLVIYAATSLASGVPSRFSGSGSGTDFTLTISSLQPEDFATYYCQQSYENPLTFGGGTKVEIK (SEQ ID NO: 1212) |
| 365_G09 | EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGANWHDTHLDYWGQGTLVTVSS (SEQ ID NO: 1034) | DIQMTQSPSSLSASVGDRVTITCRASQSIITYLNWYQQKPGKAPKLVIYAATSRASGVPSRFSGSGSGTDFTLTISSLQPEDFATYYCQQSYNSPLTFGGGTKVEIK (SEQ ID NO: 1213) |
| 365_H07 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTHLDYWGQGTLVTVSS (SEQ ID NO: 1035) | DIQMTQSPSSLSASVGDRVTITCRASQSISTYVNWYQQKPGKAPKLLIYAATSRHSGVPSRFSGSGSGTDFTLTISSLQPEDFATYYCQQSYENPLTFGGGTKVEIK (SEQ ID NO: 1214) |
| 366_A06 | EVQLLESGGGLVQPGGSLRLSCAASGFTFSDYSMNWVRQAPGKGLEWVASINYNGGYKSYADSVKGRFTISRDNSKNTLYLQMNSLRAEDTAVYYCARGANWHDTHLDYWGQGTLVTVSS (SEQ ID NO: 1036) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 1215) |
| 366_A08 | EVQLLESGGGLVQPGGSLRLSCAASGFTFDDYSMNWVRQAPGKGLEWVSGINYNSGYKGYADSVKGRFTISRDNSKNTLYLQMNSLRAEDTAVYYCARGANWHDTHLDYWGQGTLVTVSS (SEQ ID NO: 1037) | DIQMTQSPSSLSASVGDRVTITCRASQSIVSYVNWYQQKPGKAPKLVIYAATSRASGVPSRFSGSGSGTDFTLTISSLQPEDFATYYCQQSYNSPLTFGGGTKVEIK (SEQ ID NO: 1216) |
| 366_B05 | EVQLLESGGGLVQPGGSLRLSCAASGFTFSDYSMNWVRQAPGKGLEWVSGINYNSGYKSYADSVKGRFTISRDNSKNTLYLQMNSLRAEDTAVYYCARGANWHDTALDYWGQGTLVTVSS (SEQ ID NO: 1038) | DIQMTQSPSSLSASVGDRVTITCRASQSISSYLNWYQQKPGKAPKLVIYAVTSRASGVPSRFSGSGSGTDFTLTISSLQPEDFATYYCQQSYELPLTFGGGTKVEIK (SEQ ID NO: 1217) |
| 366_B07 | EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARGANWHDTHLDYWGQGTLVTVSS (SEQ ID NO: 1039) | DIQMTQSPSSLSASVGDRVTITCRASQSIVSYLNWYQQKPGKAPKLVIYATTSRASGVPSRFSGSGSGTDFTLTISSLQPEDFATYYCQQSYNSPLTFGGGTKVEIK (SEQ ID NO: 1218) |
| 366_E01 | EVQLLESGGGLVQPGGSLRLSCAASGFTFDSYGMNWVRQAPGKGLEWVSNINYNGGYKSYADSVKGRFTISRDNSKNTLYLQMNSLRAEDTAVYYCARGANWHDTHLDYWGQGTLVTVSS (SEQ ID NO: 1040) | DIQMTQSPSSLSASVGDRVTITCRASQSILTYLNWYQQKPGKAPKLLIYAATSRASGVPSRFSGSGSGTDFTLTISSLQPEDFATYYCQQSYSSPLTFGGGTKVEIK (SEQ ID NO: 1219) |
| 366_E08 | EVQLLESGGGLVQPGGSLRLSCAASGFTFSDYSMNWVRQAPGKGLEWVSNINYNGGYTSYADSVKGRFTISRDNSKNTLYLQMNSLRAEDTAVYYCARGANWHDTHLDYWGQGTLVTVSS (SEQ ID NO: 1041) | DIQMTQSPSSLSASVGDRVTITCRASQSIVTYLNWYQQKPGKAPKLLIYAATSRHSGVPSRFSGSGSGTDFTLTISSLQPEDFATYYCQQSYSNPLTFGGGTKVEIK (SEQ ID NO: 1220) |

TABLE 2C-continued

Group III Antibody Sequences

| Ab | VH sequence | VL sequence |
|---|---|---|
| 366_F02 | EVQLLESGGGLVQPGGSLRLSCAASGFTFSSY GMNWVRQAPGKGLEWVSGINYNSGYTGYADSV KGRFTISRDNSKNTLYLQMNSLRAEDTAVYYC ARGANWHDTHLDYWGQGTLVTVSS (SEQ ID NO: 1042) | DIQMTQSPSSLSASVGDRVTITCRASQSILTYLNWYQQ KPGKAPKLVIYAATSRHSGVPSRFSGSGSGTDFTLTIS SLQPEDFATYYCQQSYDNPLTFGGGTKVEIK (SEQ ID NO: 1221) |
| 366_G12 | EVQLLESGGGLVQPGGSLRLSCAASGFTFSSY GMHWVRQAPGKGLEWVSGINYNSGYKGYADSV KGRFTISRDNSKNTLYLQMNSLRAEDTAVYYC ARGANWHDTHLDYWGQGTLVTVSS (SEQ ID NO: 1043) | DIQMTQSPSSLSASVGDRVTITCRASQSILSYLNWYQQ KPGKAPKLLIYAATSRHSGVPSRFSGSGSGTDFTLTIS SLQPEDFATYYCQQSYNTPLTFGGGTKVEIK (SEQ ID NO: 1222) |
| 366_H04 | EVQLLESGGGLVQPGGSLRLSCAASGFTFDSY GMNWVRQAPGKGLEWVSNINYNGGYKSYADSV KGRFTISRDNSKNTLYLQMNSLRAEDTAVYYC ARGANWHDTHLDYWGQGTLVTVSS (SEQ ID NO: 1044) | DIQMTQSPSSLSASVGDRVTITCRASQSILTYLNWYQQ KPGKAPKLLIYAATSRASGVPSRFSGSGSGTDFTLTIS SLQPEDFATYYCQQSYSSPLTFGGGTKVEIK (SEQ ID NO: 1223) |
| 367_A03 | EVQLLESGGGLVQPGGSLRLSCAASGFTFDSY GMNWVRQAPGKGLEWVAGINYNGGYTSYADSV KGRFTISRDNSKNTLYLQMNSLRAEDTAVYYC ARGANWHDTALDYWGQGTLVTVSS (SEQ ID NO: 1045) | DIQMTQSPSSLSASVGDRVTITCRASQSILTYVNWYQQ KPGKAPKLLIYATTSRHSGVPSRFSGSGSGTDFTLTIS SLQPEDFATYYCQQSYDSPLTFGGGTKVEIK (SEQ ID NO: 1224) |
| 367_A06 | EVQLLESGGGLVQPGGSLRLSCAASGFTFDSY GMNWVRQAPGKGLEWVASINYNGGYKGYADSV KGRFTISRDNSKNTLYLQMNSLRAEDTAVYYC ARGANWHDTHLDYWGQGTLVTVSS (SEQ ID NO: 1046) | DIQMTQSPSSLSASVGDRVTITCRASQSILSYVNWYQQ KPGKAPKLLIYAATSRHSGVPSRFSGSGSGTDFTLTIS SLQPEDFATYYCQQSYDTPLTFGGGTKVEIK (SEQ ID NO: 1225) |
| 367_A08 | EVQLLESGGGLVQPGGSLRLSCAASGFTFDSY GMNWVRQAPGKGLEWVAGINYNGGYTSYADSV KGRFTISRDNSKNTLYLQMNSLRAEDTAVYYC ARGANWHDTHLDYWGQGTLVTVSS (SEQ ID NO: 1047) | DIQMTQSPSSLSASVGDRVTITCRASQSILTYLNWYQQ KPGKAPKLLIYAVTSRASGVPSRFSGSGSGTDFTLTIS SLQPEDFATYYCQQSYDSPLTFGGGTKVEIK (SEQ ID NO: 1226) |
| 367_A10 | EVQLLESGGGLVQPGGSLRLSCAASGFTFSSY GMNWVRQAPGKGLEWVAGINYNSGYTSYADSV KGRFTISRDNSKNTLYLQMNSLRAEDTAVYYC ARGANWHDTHLDYWGQGTLVTVSS (SEQ ID NO: 1048) | DIQMTQSPSSLSASVGDRVTITCRASQSIITYVNWYQQ KPGKAPKLLIYAATSLSGVPSRFSGSGSGTDFTLTIS SLQPEDFATYYCQQSYDLPLTFGGGTKVEIK (SEQ ID NO: 1227) |
| 367_A12 | EVQLLESGGGLVQPGGSLRLSCAASGFTFSSY GMNWVRQAPGKGLEWVSGINYNSGYTSYADSV KGRFTISRDNSKNTLYLQMNSLRAEDTAVYYC ARGANWHDTHLDYWGQGTLVTVSS (SEQ ID NO: 1049) | DIQMTQSPSSLSASVGDRVTITCRASQSILSYLNWYQQ KPGKAPKLLIYAATSLHSGVPSRFSGSGSGTDFTLTIS SLQPEDFATYYCQQSYNNPLTFGGGTKVEIK (SEQ ID NO: 1228) |
| 367_B01 | EVQLLESGGGLVQPGGSLRLSCAASGFTFSSY SMNWVRQAPGKGLEWVAGINYNGGYKGYADSV KGRFTISRDNSKNTLYLQMNSLRAEDTAVYYC ARGANWHDTALDYWGQGTLVTVSS (SEQ ID NO: 1050) | DIQMTQSPSSLSASVGDRVTITCRASQSISSYVNWYQQ KPGKAPKLVIYAATSRASGVPSRFSGSGSGTDFTLTIS SLQPEDFATYYCQQSYSTPLTFGGGTKVEIK (SEQ ID NO: 1229) |
| 367_B04 | EVQLLESGGGLVQPGGSLRLSCAASGFTFDSY SMNWVRQAPGKGLEWVSGINYNSGYKSYADSV KGRFTISRDNSKNTLYLQMNSLRAEDTAVYYC ARGANWHDTHLDYWGQGTLVTVSS (SEQ ID NO: 1051) | DIQMTQSPSSLSASVGDRVTITCRASQSILSYLNWYQQ KPGKAPKLLIYAATSRASGVPSRFSGSGSGTDFTLTIS SLQPEDFATYYCQQSYELPLTFGGGTKVEIK (SEQ ID NO: 1230) |
| 367_B12 | EVQLLESGGGLVQPGGSLRLSCAASGFTFSSY GMHWVRQAPGKGLEWVASINYNGGYKSYADSV KGRFTISRDNSKNTLYLQMNSLRAEDTAVYYC ARGANWHDTHLDYWGQGTLVTVSS (SEQ ID NO: 1052) | DIQMTQSPSSLSASVGDRVTITCRASQSILSYVNWYQQ KPGKAPKLVIYAATSLSGVPSRFSGSGSGTDFTLTIS SLQPEDFATYYCQQSYDTPLTFGGGTKVEIK (SEQ ID NO: 1231) |
| 367_C07 | EVQLLESGGGLVQPGGSLRLSCAASGFTFSSY SMNWVRQAPGKGLEWVSSINYNSGYTGYADSV KGRFTISRDNSKNTLYLQMNSLRAEDTAVYYC ARGANWHDTHLDYWGQGTLVTVSS (SEQ ID NO: 1053) | DIQMTQSPSSLSASVGDRVTITCRASQSILTYVNWYQQ KPGKAPKLLIYAATSRASGVPSRFSGSGSGTDFTLTIS SLQPEDFATYYCQQSYNLPLTFGGGTKVEIK (SEQ ID NO: 1232) |

TABLE 2C-continued

Group III Antibody Sequences

| Ab | VH sequence | VL sequence |
|---|---|---|
| 367_C10 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1054) | DIQMTQSPSSLSASVGDRVTITCRASQSIVSYVNWYQQKPGKAPKLLIYAVTSRASGVPSRFSGSGSGTDFTLTISSLQPEDFATYYCQQSYETPLTFGGGTKVEIK (SEQ ID NO: 1233) |
| 367_D03 | EVQLLESGGGLVQPGGSLRLSCAASGFTFDSYSMNWVRQAPGKGLEWVSSINYNGGYTGYADSVKGRFTISRDNSKNTLYLQMNSLRAEDTAVYYCARGANWHDTHLDYWGQGTLVTVSS (SEQ ID NO: 1055) | DIQMTQSPSSLSASVGDRVTITCRASQSIITYLNWYQQKPGKAPKLLIYAATSRASGVPSRFSGSGSGTDFTLTISSLQPEDFATYYCQQSYDTPLTFGGGTKVEIK (SEQ ID NO: 1234) |
| 367_D06 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTHLDYWGQGTLVTVSS (SEQ ID NO: 1056) | DIQMTQSPSSLSASVGDRVTITCRASQSISTYLNWYQQKPGKAPKLVIYAATSLASGVPSRFSGSGSGTDFTLTISSLQPEDFATYYCQQSYNSPLTFGGGTKVEIK (SEQ ID NO: 1235) |
| 367_D08 | EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARGANWHDTHLDYWGQGTLVTVSS (SEQ ID NO: 1057) | DIQMTQSPSSLSASVGDRVTITCRASQSILSYLNWYQQKPGKAPKLVIYAATSRHSGVPSRFSGSGSGTDFTLTISSLQPEDFATYYCQQSDDLPLTFGGGTKVEIK (SEQ ID NO: 1236) |
| 367_D12 | EVQLLESGGGLVQPGGSLRLSCAASGFTFSSYSMNWVRQAPGKGLEWVSSINYNGGYTSYADSVKGRFTISRDNSKNTLYLQMNSLRAEDTAVYYCARGANWHDTHLDYWGQGTLVTVSS (SEQ ID NO: 1058) | DIQMTQSPSSLSASVGDRVTITCRASQSIVSYVNWYQQKPGKAPKLVIYAATSRASGVPSRFSGSGSGTDFTLTISSLQPEDFATYYCQQSYESPLTFGGGTKVEIK (SEQ ID NO: 1237) |
| 367_E05 | EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARGANWHDTHLDYWGQGTLVTVSS (SEQ ID NO: 1059) | DIQMTQSPSSLSASVGDRVTITCRASQSILSYLNWYQQKPGKAPKLLIYAATSRHSGVPSRFSGSGSGTDFTLTISSLQPEDFATYYCQQSYDSPLTFGGGTKVEIK (SEQ ID NO: 1238) |
| 367_F01 | EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARGANWHDTHLDYWGQGTLVTVSS (SEQ ID NO: 1060) | DIQMTQSPSSLSASVGDRVTITCRASQSIISYLNWYQQKPGKAPKLLIYAASSLQSGVPSRFSGSGSGTDFTLTISSLQPEDFATYYCQQSYSTPLTFGGGTKVEIK (SEQ ID NO: 1239) |
| 367_G01 | EVQLLESGGGLVQPGGSLRLSCAASGFTFDSYGMNWVRQAPGKGLEWVASINYNSGYTGYADSVKGRFTISRDNSKNTLYLQMNSLRAEDTAVYYCARGANWHDTHLDYWGQGTLVTVSS (SEQ ID NO: 1061) | DIQMTQSPSSLSASVGDRVTITCRASQSISSYLNWYQQKPGKAPKLVIYAATSRASGVPSRFSGSGSGTDFTLTISSLQPEDFATYYCQQSYDLPLTFGGGTKVEIK (SEQ ID NO: 1240) |
| 367_G04 | EVQLLESGGGLVQPGGSLRLSCAASGFTFSSYSMNWVRQAPGKGLEWVAGINYNSGYTSYADSVKGRFTISRDNSKNTLYLQMNSLRAEDTAVYYCARGANWHDTHLDYWGQGTLVTVSS (SEQ ID NO: 1062) | DIQMTQSPSSLSASVGDRVTITCRASQSILSYLNWYQQKPGKAPKLVIYAATSRASGVPSRFSGSGSGTDFTLTISSLQPEDFATYYCQQSYDSPLTFGGGTKVEIK (SEQ ID NO: 1241) |
| 367_H02 | EVQLLESGGGLVQPGGSLRLSCAASGFTFDSYGMNWVRQAPGKGLEWVSSINYNGGYTGYADSVKGRFTISRDNSKNTLYLQMNSLRAEDTAVYYCARGANWHDTHLDYWGQGTLVTVSS (SEQ ID NO: 1063) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 1242) |
| 367_H03 | EVQLLESGGGLVQPGGSLRLSCAASGFTFSSYGMNWVRQAPGKGLEWVAGINYNSGYTSYADSVKGRFTISRDNSKNTLYLQMNSLRAEDTAVYYCARGANWHDTHLDYWGQGTLVTVSS (SEQ ID NO: 1064) | DIQMTQSPSSLSASVGDRVTITCRASQSIITYVNWYQQKPGKAPKLLIYAATSLASGVPSRFSGSGSGTDFTLTISSLQPEDFATYYCQQSYDLPLTFGGGTKVEIK (SEQ ID NO: 1243) |
| 368_A03 | EVQLLESGGGLVQPGGSLRLSCAASGFTFSSYSMNWVRQAPGKGLEWVSGINYNGGYTGYADSVKGRFTISRDNSKNTLYLQMNSLRAEDTAVYYCARGANWHDTHLDYWGQGTLVTVSS (SEQ ID NO: 1065) | DIQMTQSPSSLSASVGDRVTITCRASQSIISYLNWYQQKPGKAPKLLIYAVTSRASGVPSRFSGSGSGTDFTLTISSLQPEDFATYYCQQSYENPLTFGGGTKVEIK (SEQ ID NO: 1244) |

TABLE 2C-continued

Group III Antibody Sequences

| Ab | VH sequence | VL sequence |
|---|---|---|
| 368_A04 | EVQLLESGGGLVQPGGSLRLSCAASGFTFDDY SMNWVRQAPGKGLEWVAGINYNGGYKSYADSV KGRFTISRDNSKNTLYLQMNSLRAEDTAVYYC ARGANWHDTHLDYWGQGTLVTVSS (SEQ ID NO: 1066) | DIQMTQSPSSLSASVGDRVTITCRASQSILTYLNWYQQ KPGKAPKLVIYAVTSRASGVPSRFSGSGSGTDFTLTIS SLQPEDFATYYCQQSYELPLTFGGGTKVEIK (SEQ ID NO: 1245) |
| 368_B09 | EVQLLESGGGLVQPGGSLRLSCAASGFTFDSY GMNWVRQAPGKGLEWVSNINYNGGYKGYADSV KGRFTISRDNSKNTLYLQMNSLRAEDTAVYYC ARGANWHDTHLDYWGQGTLVTVSS (SEQ ID NO: 1067) | DIQMTQSPSSLSASVGDRVTITCRASQSILSYLNWYQQ KPGKAPKLLIYAATSRHSGVPSRFSGSGSGTDFTLTIS SLQPEDFATYYCQQSYDTPLTFGGGTKVEIK (SEQ ID NO: 1246) |
| 368_C02 | EVQLLESGGGLVQPGGSLRLSCAASGFTFDDY SMNWVRQAPGKGLEWVANINYNGGYKGYADSV KGRFTISRDNSKNTLYLQMNSLRAEDTAVYYC ARGANWHDTHLDYWGQGTLVTVSS (SEQ ID NO: 1068) | DIQMTQSPSSLSASVGDRVTITCRASQSISTYVNWYQQ KPGKAPKLLIYAATSLASGVPSRFSGSGSGTDFTLTIS SLQPEDFATYYCQQSYSTPLTFGGGTKVEIK (SEQ ID NO: 1247) |
| 368_C08 | EVQLLESGGGLVQPGGSLRLSCAASGFTFSDY SMNWVRQAPGKGLEWVSGINYNGGYTSYADSV KGRFTISRDNSKNTLYLQMNSLRAEDTAVYYC ARGANWHDTHLDYWGQGTLVTVSS (SEQ ID NO: 1069) | DIQMTQSPSSLSASVGDRVTITCRASQSILTYVNWYQQ KPGKAPKLLIYAASSLQSGVPSRFSGSGSGTDFTLTIS SLQPEDFATYYCQQSYSTPLTFGGGTKVEIK (SEQ ID NO: 1248) |
| 368_E12 | EVQLLESGGGLVQPGGSLRLSCAASGFTFSDY GMNWVRQAPGKGLEWVAGINYNGGYTSYADSV KGRFTISRDNSKNTLYLQMNSLRAEDTAVYYC ARGANWHDTHLDYWGQGTLVTVSS (SEQ ID NO: 1070) | DIQMTQSPSSLSASVGDRVTITCRASQSIVSYVNWYQQ KPGKAPKLVIYAVTSRASGVPSRFSGSGSGTDFTLTIS SLQPEDFATYYCQQSYDSPLTFGGGTKVEIK (SEQ ID NO: 1249) |
| 368_F09 | EVQLLESGGGLVQPGGSLRLSCAASGFTFSSY GMNWVRQAPGKGLEWVSGINYNSGYTSYADSV KGRFTISRDNSKNTLYLQMNSLRAEDTAVYYC ARGANWHDTHLDYWGQGTLVTVSS (SEQ ID NO: 1071) | DIQMTQSPSSLSASVGDRVTITCRASQSILTYLNWYQQ KPGKAPKLLIYAASSLQSGVPSRFSGSGSGTDFTLTIS SLQPEDFATYYCQQSYETPLTFGGGTKVEIK (SEQ ID NO: 1250) |
| 368_H02 | EVQLLESGGGLVQPGGSLRLSCAASGFTFSSY GMNWVRQAPGKGLEWVAGINYNSGYTSYADSV KGRFTISRDNSKNTLYLQMNSLRAEDTAVYYC ARGANWHDTALDYWGQGTLVTVSS (SEQ ID NO: 1072) | DIQMTQSPSSLSASVGDRVTITCRASQSIVTYLNWYQQ KPGKAPKLVIYAATSRASGVPSRFSGSGSGTDFTLTIS SLQPEDFATYYCQQSYESPLTFGGGTKVEIK (SEQ ID NO: 1251) |
| 368_H05 | EVQLLESGGGLVQPGGSLRLSCAASGFTFSSY SMNWVRQAPGKGLEWVANINYNGGYKSYADSV KGRFTISRDNSKNTLYLQMNSLRAEDTAVYYC ARGANWHDTHLDYWGQGTLVTVSS (SEQ ID NO: 1073) | DIQMTQSPSSLSASVGDRVTITCRASQSIVSYVNWYQQ KPGKAPKLVIYATTSRASGVPSRFSGSGSGTDFTLTIS SLQPEDFATYYCQQSYESPLTFGGGTKVEIK (SEQ ID NO: 1252) |
| 369_A07 | EVQLLESGGGLVQPGGSLRLSCAASGFTFSSY SMNWVRQAPGKGLEWVAGINYNGGYKGYADSV KGRFTISRDNSKNTLYLQMNSLRAEDTAVYYC ARGANWHDTALDYWGQGTLVTVSS (SEQ ID NO: 1074) | DIQMTQSPSSLSASVGDRVTITCRASQSILSYLNWYQQ KPGKAPKLVIYAATSRASGVPSRFSGSGSGTDFTLTIS SLQPEDFATYYCQQSYESPLTFGGGTKVEIK (SEQ ID NO: 1253) |
| 369_B05 | EVQLLESGGGLVQPGGSLRLSCAASGFTFDSY SMNWVRQAPGKGLEWVSGINYNGGYKSYADSV KGRFTISRDNSKNTLYLQMNSLRAEDTAVYYC ARGANWHDTHLDYWGQGTLVTVSS (SEQ ID NO: 1075) | DIQMTQSPSSLSASVGDRVTITCRASQSIISYLNWYQQ KPGKAPKLLIYAATSLASGVPSRFSGSGSGTDFTLTIS SLQPEDFATYYCQQSYDTPLTFGGGTKVEIK (SEQ ID NO: 1254) |
| 369_C05 | EVQLLESGGGLVQPGGSLRLSCAASGFTFDSY SMNWVRQAPGKGLEWVAGINYNGGYTSYADSV KGRFTISRDNSKNTLYLQMNSLRAEDTAVYYC ARGANWHDTALDYWGQGTLVTVSS (SEQ ID NO: 1076) | DIQMTQSPSSLSASVGDRVTITCRASQSISSYVNWYQQ KPGKAPKLVIYATTSRHSGVPSRFSGSGSGTDFTLTIS SLQPEDFATYYCQQSYNSPLTFGGGTKVEIK (SEQ ID NO: 1255) |
| 369_D03 | EVQLLESGGGLVQPGGSLRLSCAASGFTFSSY SMNWVRQAPGKGLEWVSGINYNGGYTSYADSV KGRFTISRDNSKNTLYLQMNSLRAEDTAVYYC ARGANWHDTHLDYWGQGTLVTVSS (SEQ ID NO: 1077) | DIQMTQSPSSLSASVGDRVTITCRASQSILTYLNWYQQ KPGKAPKLVIYAATSRASGVPSRFSGSGSGTDFTLTIS SLQPEDFATYYCQQSYENPLTFGGGTKVEIK (SEQ ID NO: 1256) |

TABLE 2C-continued

Group III Antibody Sequences

| Ab | VH sequence | VL sequence |
|---|---|---|
| 369_D07 | EVQLLESGGGLVQPGGSLRLSCAASGFTFSSY GMNWVRQAPGKGLEWVSGINYNGGYKSYADSV KGRFTISRDNSKNTLYLQMNSLRAEDTAVYYC ARGANWHDTHLDYWGQGTLVTVSS (SEQ ID NO: 1078) | DIQMTQSPSSLSASVGDRVTITCRASQSIVSYLNWYQQ KPGKAPKLVIYAATSRASGVPSRFSGSGSGTDFTLTIS SLQPEDFATYYCQQSYDLPLTFGGGTKVEIK (SEQ ID NO: 1257) |
| 369_D09 | EVQLLESGGGLVQPGGSLRLSCAASGFTFSDY GMNWVRQAPGKGLEWVSNINYNGGYTSYADSV KGRFTISRDNSKNTLYLQMNSLRAEDTAVYYC ARGANWHDTALDYWGQGTLVTVSS (SEQ ID NO: 1079) | DIQMTQSPSSLSASVGDRVTITCRASQSILTYLNWYQQ KPGKAPKLLIYAATSRASGVPSRFSGSGSGTDFTLTIS SLQPEDFATYYCQQSYDSPLTFGGGTKVEIK (SEQ ID NO: 1258) |
| 369_E06 | EVQLLESGGGLVQPGGSLRLSCAASGFTFSSY GMNWVRQAPGKGLEWVSGINYNGGYTSYADSV KGRFTISRDNSKNTLYLQMNSLRAEDTAVYYC ARGANWHDTALDYWGQGTLVTVSS (SEQ ID NO: 1080) | DIQMTQSPSSLSASVGDRVTITCRASQSIISYLNWYQQ KPGKAPKLVIYAATSRHSGVPSRFSGSGSGTDFTLTIS SLQPEDFATYYCQQSYDSPLTFGGGTKVEIK (SEQ ID NO: 1259) |
| 369_F08 | EVQLLESGGGLVQPGGSLRLSCAASGFTFSDY GMHWVRQAPGKGLEWVSGINYNGSYTSYADSV KGRFTISRDNSKNTLYLQMNSLRAEDTAVYYC ARGANWHDTALDYWGQGTLVTVSS (SEQ ID NO: 1081) | DIQMTQSPSSLSASVGDRVTITCRASQSILSYLNWYQQ KPGKAPKLLIYAASSLQSGVPSRFSGSGSGTDFTLTIS SLQPEDFATYYCQQSYDLPLTFGGGTKVEIK (SEQ ID NO: 1260) |
| 369_G08 | EVQLLESGGGLVQPGGSLRLSCAASGFTFDSY SMNWVRQAPGKGLEWVSSINYNGGYKGYADSV KGRFTISRDNSKNTLYLQMNSLRAEDTAVYYC ARGANWHDTHLDYWGQGTLVTVSS (SEQ ID NO: 1082) | DIQMTQSPSSLSASVGDRVTITCRASQSILTYLNWYQQ KPGKAPKLLIYAASSLQSGVPSRFSGSGSGTDFTLTIS SLQPEDFATYYCQQSYSTPLTFGGGTKVEIK (SEQ ID NO: 1261) |
| 370_A02 | EVQLLESGGGLVQPGGSLRLSCAASGFTFDSY GMNWVRQAPGKGLEWVAGINYNGGYTGYADSV KGRFTISRDNSKNTLYLQMNSLRAEDTAVYYC ARGANWHDTALDYWGQGTLVTVSS (SEQ ID NO: 1083) | DIQMTQSPSSLSASVGDRVTITCRASQSIVTYLNWYQQ KPGKAPKLVIYAATSRASGVPSRFSGSGSGTDFTLTIS SLQPEDFATYYCQQSYDSPLTFGGGTKVEIK (SEQ ID NO: 1262) |
| 370_B03 | EVQLLESGGGLVQPGGSLRLSCAASGFTFSSY SMNWVRQAPGKGLEWVANINYNGGYTGYADSV KGRFTISRDNSKNTLYLQMNSLRAEDTAVYYC ARGANWHDTALDYWGQGTLVTVSS (SEQ ID NO: 1084) | DIQMTQSPSSLSASVGDRVTITCRASQSILSYLNWYQQ KPGKAPKLVIYAATSRASGVPSRFSGSGSGTDFTLTIS SLQPEDFATYYCQQSYNNPLTFGGGTKVEIK (SEQ ID NO: 1263) |
| 370_B11 | EVQLLESGGGLVQPGGSLRLSCAASGFTFDSY SMNWVRQAPGKGLEWVSGINYNSGYTSYADSV KGRFTISRDNSKNTLYLQMNSLRAEDTAVYYC ARGANWHDTHLDYWGQGTLVTVSS (SEQ ID NO: 1085) | DIQMTQSPSSLSASVGDRVTITCRASQSILSYLNWYQQ KPGKAPKLVIYAATSRHSGVPSRFSGSGSGTDFTLTIS SLQPEDFATYYCQQGYDLPLTFGGGTKVEIK (SEQ ID NO: 1264) |
| 370_B12 | EVQLLESGGGLVQPGGSLRLSCAASGFTFSDY SMNWVRQAPGKGLEWVSGINYNGGYKGYADSV KGRFTISRDNSKNTLYLQMNSLRAEDTAVYYC ARGANWHDTALDYWGQGTLVTVSS (SEQ ID NO: 1086) | DIQMTQSPSSLSASVGDRVTITCRASQSILSYVNWYQQ KPGKAPKLVIYATTSRASGVPSRFSGSGSGTDFTLTIS SLQPEDFATYYCQQSYETPLTFGGGTKVEIK (SEQ ID NO: 1265) |
| 370_D01 | EVQLLESGGGLVQPGGSLRLSCAASGFTFSSY SMNWVRQAPGKGLEWVSSINYNGGYTGYADSV KGRFTISRDNSKNTLYLQMNSLRAEDTAVYYC ARGANWHDTALDYWGQGTLVTVSS (SEQ ID NO: 1087) | DIQMTQSPSSLSASVGDRVTITCRASQSILSYLNWYQQ KPGKAPKLLIYAATSRHSGVPSRFSGSGSGTDFTLTIS SLQPEDFATYYCQQSYNTPLTFGGGTKVEIK (SEQ ID NO: 1266) |
| 370_D05 | EVQLLESGGGLVQPGGSLRLSCAASGFTFDDY SMNWVRQAPGKGLEWVSNINYNGGYKGYADSV KGRFTISRDNSKNTLYLQMNSLRAEDTAVYYC ARGANWHDTALDYWGQGTLVTVSS (SEQ ID NO: 1088) | DIQMTQSPSSLSASVGDRVTITCRASQSIITYLNWYQQ KPGKAPKLVIYAATSRHSGVPSRFSGSGSGTDFTLTIS SLQPEDFATYYCQQSYDTPLTFGGGTKVEIK (SEQ ID NO: 1267) |
| 370_F03 | EVQLLESGGGLVQPGGSLRLSCAASGFTFSSY GMNWVRQAPGKGLEWVSSINYNSGYKSYADSV KGRFTISRDNSKNTLYLQMNSLRAEDTAVYYC ARGANWHDTALDYWGQGTLVTVSS (SEQ ID NO: 1089) | DIQMTQSPSSLSASVGDRVTITCRASQSILSYVNWYQQ KPGKAPKLLIYAATSRASGVPSRFSGSGSGTDFTLTIS SLQPEDFATYYCQQSYENPLTFGGGTKVEIK (SEQ ID NO: 1268) |

TABLE 2C-continued

Group III Antibody Sequences

| Ab | VH sequence | VL sequence |
|---|---|---|
| 370_H02 | EVQLLESGGGLVQPGGSLRLSCAASGFTFDSY SMNWVRQAPGKGLEWVSGINYNSGYTSYADSV KGRFTISRDNSKNTLYLQMNSLRAEDTAVYYC ARGANWHDTHLDYWGQGTLVTVSS (SEQ ID NO: 1090) | DIQMTQSPSSLSASVGDRVTITCRASQSILTYLNWYQQ KPGKAPKLLIYAATSRASGVPSRFSGSGSGTDFTLTIS SLQPEDFATYYCQQSYESPLTFGGGTKVEIK (SEQ ID NO: 1269) |
| 370_H07 | EVQLLESGGGLVQPGGSLRLSCAASGFTFSSY SMNWVRQAPGKGLEWVAGINYNGGYKSYADSV KGRFTISRDNSKNTLYLQMNSLRAEDTAVYYC ARGANWHDTALDYWGQGTLVTVSS (SEQ ID NO: 1091) | DIQMTQSPSSLSASVGDRVTITCRASQSILSYLNWYQQ KPGKAPKLLIYAATSLASGVPSRFSGSGSGTDFTLTIS SLQPEDFATYYCQQSDSSPLTFGGGTKVEIK (SEQ ID NO: 1270) |
| 371_A10 | EVQLLESGGGLVQPGGSLRLSCAASGFTFDDY SMNWVRQAPGKGLEWVSGINYNGGYKGYADSV KGRFTISRDNSKNTLYLQMNSLRAEDTAVYYC ARGANWHDTALDYWGQGTLVTVSS (SEQ ID NO: 1092) | DIQMTQSPSSLSASVGDRVTITCRASQSIVSYLNWYQQ KPGKAPKLVIYAATSRASGVPSRFSGSGSGTDFTLTIS SLQPEDFATYYCQQSYENPLTFGGGTKVEIK (SEQ ID NO: 1271) |
| 371_B03 | EVQLLESGGGLVQPGGSLRLSCAASGFTFSSY GMHWVRQAPGKGLEWVASINYNGGYTSYADSV KGRFTISRDNSKNTLYLQMNSLRAEDTAVYYC ARGANWHDTHLDYWGQGTLVTVSS (SEQ ID NO: 1093) | DIQMTQSPSSLSASVGDRVTITCRASQSILSYVNWYQQ KPGKAPKLLIYATTSRASGVPSRFSGSGSGTDFTLTIS SLQPEDFATYYCQQSYDNPLTFGGGTKVEIK (SEQ ID NO: 1272) |
| 371_B04 | EVQLLESGGGLVQPGGSLRLSCAASGFTFSSY SMNWVRQAPGKGLEWVSGINYNGGYKSYADSV KGRFTISRDNSKNTLYLQMNSLRAEDTAVYYC ARGANWHDTALDYWGQGTLVTVSS (SEQ ID NO: 1094) | DIQMTQSPSSLSASVGDRVTITCRASQSILSYLNWYQQ KPGKAPKLVIYAVTSRHSGVPSRFSGSGSGTDFTLTIS SLQPEDFATYYCQQSYDSPLTFGGGTKVEIK (SEQ ID NO: 1273) |
| 371_B09 | EVQLLESGGGLVQPGGSLRLSCAASGFTFSSY SMNWVRQAPGKGLEWVAGINYNSGYTGYADSV KGRFTISRDNSKNTLYLQMNSLRAEDTAVYYC ARGANWHDTHLDYWGQGTLVTVSS (SEQ ID NO: 1095) | DIQMTQSPSSLSASVGDRVTITCRASQSILSYVNWYQQ KPGKAPKLVIYATTSLASGVPSRFSGSGSGTDFTLTIS SLQPEDFATYYCQQSYDTPLTFGGGTKVEIK (SEQ ID NO: 1274) |
| 371_B12 | EVQLLESGGGLVQPGGSLRLSCAASGFTFSDY SMNWVRQAPGKGLEWVAGINYNSGYTSYADSV KGRFTISRDNSKNTLYLQMNSLRAEDTAVYYC ARGANWHDTALDYWGQGTLVTVSS (SEQ ID NO: 1096) | DIQMTQSPSSLSASVGDRVTITCRASQSIVTYLNWYQQ KPGKAPKLVIYAATSRHSGVPSRFSGSGSGTDFTLTIS SLQPEDFATYYCQQSYNNPLTFGGGTKVEIK (SEQ ID NO: 1275) |
| 371_C01 | EVQLLESGGGLVQPGGSLRLSCAASGFTFSSY GMHWVRQAPGKGLEWVSSINYNGGYTGYADSV KGRFTISRDNSKNTLYLQMNSLRAEDTAVYYC ARGANWHDTHLDYWGQGTLVTVSS (SEQ ID NO: 1097) | DIQMTQSPSSLSASVGDRVTITCRASQSIVSYLNWYQQ KPGKAPKLLIYAATSRHSGVPSRFSGSGSGTDFTLTIS SLQPEDFATYYCQQSYDNPLTFGGGTKVEIK (SEQ ID NO: 1276) |
| 371_C04 | EVQLLESGGGLVQPGGSLRLSCAASGFTFDSY GMNWVRQAPGKGLEWVSGINYNSGYKGYADSV KGRFTISRDNSKNTLYLQMNSLRAEDTAVYYC ARGANWHDTALDYWGQGTLVTVSS (SEQ ID NO: 1098) | DIQMTQSPSSLSASVGDRVTITCRASQSILSYLNWYQQ KPGKAPKLLIYAATSRASGVPSRFSGSGSGTDFTLTIS SLQPEDFATYYCQQSYSTPLTFGGGTKVEIK (SEQ ID NO: 1277) |
| 371_C05 | EVQLLESGGGLVQPGGSLRLSCAASGFTFSDY GMHWVRQAPGKGLEWVANINYNGGYTGYADSV KGRFTISRDNSKNTLYLQMNSLRAEDTAVYYC ARGANWHDTALDYWGQGTLVTVSS (SEQ ID NO: 1099) | DIQMTQSPSSLSASVGDRVTITCRASQSILSYLNWYQQ KPGKAPKLLIYAATSRASGVPSRFSGSGSGTDFTLTIS SLQPEDFATYYCQQSYDSPLTFGGGTKVEIK (SEQ ID NO: 1278) |
| 371_C12 | EVQLLESGGGLVQPGGSLRLSCAASGFTFSSY SMNWVRQAPGKGLEWVAGINYNSGYKSYADSV KGRFTISRDNSKNTLYLQMNSLRAEDTAVYYC ARGANWHDTHLDYWGQGTLVTVSS (SEQ ID NO: 1100) | DIQMTQSPSSLSASVGDRVTITCRASQSIVSYVNWYQQ KPGKAPKLLIYAATSRASGVPSRFSGSGSGTDFTLTIS SLQPEDFATYYCQQSYDTPLTFGGGTKVEIK (SEQ ID NO: 1279) |
| 371_D02 | EVQLLESGGGLVQPGGSLRLSCAASGFTFDDY SMNWVRQAPGKGLEWVAGINYNGGYKSYADSV KGRFTISRDNSKNTLYLQMNSLRAEDTAVYYC ARGANWHDTALDYWGQGTLVTVSS (SEQ ID NO: 1101) | DIQMTQSPSSLSASVGDRVTITCRASQSIVTYLNWYQQ KPGKAPKLLIYAATSRASGVPSRFSGSGSGTDFTLTIS SLQPEDFATYYCQQSYDSPLTFGGGTKVEIK (SEQ ID NO: 1280) |

TABLE 2C-continued

Group III Antibody Sequences

| Ab | VH sequence | VL sequence |
|---|---|---|
| 371_D04 | EVQLLESGGGLVQPGGSLRLSCAASGFTFDDY SMNWVRQAPGKGLEWVAGINYNGGYTGYADSV KGRFTISRDNSKNTLYLQMNSLRAEDTAVYYC ARGANWHDTHLDYWGQGTLVTVSS (SEQ NO: 1102) | DIQMTQSPSSLSASVGDRVTITCRASQSIVSYVNWYQQ KPGKAPKLLIYAATSLASGVPSRFSGSGSGTDFTLTIS SLQPEDFATYYCQQSYENPLTFGGGTKVEIK (SEQ ID NO: 1281) |
| 371_E06 | EVQLLESGGGLVQPGGSLRLSCAASGFTFSSY SMNWVRQAPGKGLEWVSGINYNGGYTSYADSV KGRFTISRDNSKNTLYLQMNSLRAEDTAVYYC ARGANWHDTALDYWGQGTLVTVSS (SEQ NO: 1103) | DIQMTQSPSSLSASVGDRVTITCRASQSISTYLNWYQQ KPGKAPKLLIYAVTSLHSGVPSRFSGSGSGTDFTLTIS SLQPEDFATYYCQQSYESPLTFGGGTKVEIK (SEQ ID NO: 1282) |
| 371_E07 | EVQLLESGGGLVQPGGSLRLSCAASGFTFDSY SMNWVRQAPGKGLEWVAGINYNGGYTSYADSV KGRFTISRDNSKNTLYLQMNSLRAEDTAVYYC ARGANWHDTALDYWGQGTLVTVSS (SEQ NO: 1104) | DIQMTQSPSSLSASVGDRVTITCRASQSIISYLNWYQQ KPGKAPKLLIYAATSLASGVPSRFSGSGSGTDFTLTIS SLQPEDFATYYCQQSYESPLTFGGGTKVEIK (SEQ ID NO: 1283) |
| 371_E10 | EVQLLESGGGLVQPGGSLRLSCAASGFTFDSY SMNWVRQAPGKGLEWVAGINYNGGYTSYADSV KGRFTISRDNSKNTLYLQMNSLRAEDTAVYYC ARGANWHDTALDYWGQGTLVTVSS (SEQ NO: 1105) | DIQMTQSPSSLSASVGDRVTITCRASQSISTYLNWYQQ KPGKAPKLLIYAVTSRASGVPSRFSGSGSGTDFTLTIS SLQPEDFATYYCQQSYNSPLTFGGGTKVEIK (SEQ ID NO: 1284) |
| 371_F10 | EVQLLESGGGLVQPGGSLRLSCAASGFTFDSY GMNWVRQAPGKGLEWVSGINYNSGYTSYADSV KGRFTISRDNSKNTLYLQMNSLRAEDTAVYYC ARGANWHDTALDYWGQGTLVTVSS (SEQ NO: 1106) | DIQMTQSPSSLSASVGDRVTITCRASQSISSYLNWYQQ KPGKAPKLVIYAVTSRASGVPSRFSGSGSGTDFTLTIS SLQPEDFATYYCQQSYESPLTFGGGTKVEIK (SEQ ID NO: 1285) |
| 371_F11 | EVQLLESGGGLVQPGGSLRLSCAASGFTFSSY SMNWVRQAPGKGLEWVSGINYNGGYTSYADSV KGRFTISRDNSKNTLYLQMNSLRAEDTAVYYC ARGANWHDTALDYWGQGTLVTVSS (SEQ NO: 1107) | DIQMTQSPSSLSASVGDRVTITCRASQSIISYVNWYQQ KPGKAPKLLIYAVTSRASGVPSRFSGSGSGTDFTLTIS SLQPEDFATYYCQQSYDLPLTFGGGTKVEIK (SEQ ID NO: 1286) |
| 371_G02 | EVQLLESGGGLVQPGGSLRLSCAASGFTFDSY GMNWVRQAPGKGLEWVASINYNGGYTSYADSV KGRFTISRDNSKNTLYLQMNSLRAEDTAVYYC ARGANWHDTHLDYWGQGTLVTVSS (SEQ NO: 1108) | DIQMTQSPSSLSASVGDRVTITCRASQSILSYLNWYQQ KPGKAPKLLIYAATSRASGVPSRFSGSGSGTDFTLTIS SLQPEDFATYYCQQSYDLPLTFGGGTKVEIK (SEQ ID NO: 1287) |
| 371_G04 | EVQLLESGGGLVQPGGSLRLSCAASGFTFDSY SMNWVRQAPGKGLEWVSGINYNGGYKSYADSV KGRFTISRDNSKNTLYLQMNSLRAEDTAVYYC ARGANWHDTALDYWGQGTLVTVSS (SEQ NO: 1109) | DIQMTQSPSSLSASVGDRVTITCRASQSILSYLNWYQQ KPGKAPKLLIYAATSLHSGVPSRFSGSGSGTDFTLTIS SLQPEDFATYYCQQSYESPLTFGGGTKVEIK (SEQ ID NO: 1288) |
| 371_G09 | EVQLLESGGGLVQPGGSLRLSCAASGFTFSSY SMNWVRQAPGKGLEWVANINYNGGYTGYADSV KGRFTISRDNSKNTLYLQMNSLRAEDTAVYYC ARGANWHDTALDYWGQGTLVTVSS (SEQ NO: 1110) | DIQMTQSPSSLSASVGDRVTITCRASQSILSYLNWYQQ KPGKAPKLVIYAATSRASGVPSRFSGSGSGTDFTLTIS SLQPEDFATYYCQQSDSTPLTFGGGTKVEIK (SEQ ID NO: 1289) |
| 371_G11 | EVQLLESGGGLVQPGGSLRLSCAASGFTFSSY GMNWVRQAPGKGLEWVSNINYNSGYTSYADSV KGRFTISRDNSKNTLYLQMNSLRAEDTAVYYC ARGANWHDTALDYWGQGTLVTVSS (SEQ NO: 1111) | DIQMTQSPSSLSASVGDRVTITCRASQSILSYVNWYQQ KPGKAPKLLIYAATSLASGVPSRFSGSGSGTDFTLTIS SLQPEDFATYYCQQSYDSPLTFGGGTKVEIK (SEQ ID NO: 1290) |
| 371_H04 | EVQLLESGGGLVQPGGSLRLSCAASGFTFSSY GMNWVRQAPGKGLEWVSNINYNGGYTSYADSV KGRFTISRDNSKNTLYLQMNSLRAEDTAVYYC ARGANWHDTALDYWGQGTLVTVSS (SEQ NO: 1112) | DIQMTQSPSSLSASVGDRVTITCRASQSILTYLNWYQQ KPGKAPKLLIYAATSRASGVPSRFSGSGSGTDFTLTIS SLQPEDFATYYCQQSYNSPLTFGGGTKVEIK (SEQ ID NO: 1291) |
| 371_H05 | EVQLLESGGGLVQPGGSLRLSCAASGFTFSSY GMNWVRQAPGKGLEWVSGINYNSGYKSYADSV KGRFTISRDNSKNTLYLQMNSLRAEDTAVYYC ARGANWHDTALDYWGQGTLVTVSS (SEQ NO: 1113) | DIQMTQSPSSLSASVGDRVTITCRASQSIISYLNWYQQ KPGKAPKLLIYAATSLASGVPSRFSGSGSGTDFTLTIS SLQPEDFATYYCQQSYSLPLTFGGGTKVEIK (SEQ ID NO: 1292) |

TABLE 2C-continued

Group III Antibody Sequences

| Ab | VH sequence | VL sequence |
|---|---|---|
| 371_H06 | EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1114) | DIQMTQSPSSLSASVGDRVTITCRASQSISSYLNWYQQKPGKAPKLVIYAVTSRASGVPSRFSGSGSGTDFTLTISSLQPEDFATYYCQQSYDLPLTFGGGTKVEIK (SEQ ID NO: 1293) |
| 371_H08 | EVQLLESGGGLVQPGGSLRLSCAASGFTFSSYGMNWVRQAPGKGLEWVASINYNGGYKGYADSVKGRFTISRDNSKNTLYLQMNSLRAEDTAVYYCARGANWHDTHLDYWGQGTLVTVSS (SEQ ID NO: 1115) | DIQMTQSPSSLSASVGDRVTITCRASQSIISYVNWYQQKPGKAPKLVIYAVTSRASGVPSRFSGSGSGTDFTLTISSLQPEDFATYYCQQSYDTPLTFGGGTKVEIK (SEQ ID NO: 1294) |
| 371_H10 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGANWHDTHLDYWGQGTLVTVSS (SEQ ID NO: 1116) | DIQMTQSPSSLSASVGDRVTITCRASQSISTYLNWYQQKPGKAPKLLIYAATSRHSGVPSRFSGSGSGTDFTLTISSLQPEDFATYYCQQSYENPLTFGGGTKVEIK (SEQ ID NO: 1295) |
| 372_B02 | EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARGANWHDTALDYWGQGTLVTVSS (SEQ ID NO: 1117) | DIQMTQSPSSLSASVGDRVTITCRASQSILSYVNWYQQKPGKAPKLLIYAVTSLASGVPSRFSGSGSGTDFTLTISSLQPEDFATYYCQQSYETPLTFGGGTKVEIK (SEQ ID NO: 1296) |
| 372_C06 | EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1118) | DIQMTQSPSSLSASVGDRVTITCRASQSIVSYVNWYQQKPGKAPKLLIYAATSRASGVPSRFSGSGSGTDFTLTISSLQPEDFATYYCQQSYSSPLTFGGGTKVEIK (SEQ ID NO: 1297) |
| 372_D03 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGANWHDTALDYWGQGTLVTVSS (SEQ ID NO: 1119) | DIQMTQSPSSLSASVGDRVTITCRASQSILSYVNWYQQKPGKAPKLVIYAVTSRHSGVPSRFSGSGSGTDFTLTISSLQPEDFATYYCQQSYDSPLTFGGGTKVEIK (SEQ ID NO: 1298) |
| 372_E01 | EVQLLESGGGLVQPGGSLRLSCAASGFTFDDYSMNWVRQAPGKGLEWVSGINYNGGYKGYADSVKGRFTISRDNSKNTLYLQMNSLRAEDTAVYYCARGANWHDTALDYWGQGTLVTVSS (SEQ ID NO: 1120) | DIQMTQSPSSLSASVGDRVTITCRASQSIVSYLNWYQQKPGKAPKLVIYAATSRHSGVPSRFSGSGSGTDFTLTISSLQPEDFATYYCQQSYDSPLTFGGGTKVEIK (SEQ ID NO: 1299) |
| 372_G12 | EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARGANWHDTHLDYWGQGTLVTVSS (SEQ ID NO: 1121) | DIQMTQSPSSLSASVGDRVTITCRASQSILTYLNWYQQKPGKAPKLVIYAATSRHSGVPSRFSGSGSGTDFTLTISSLQPEDFATYYCQQSYDSPLTFGGGTKVEIK (SEQ ID NO: 1300) |
| 373_A01 | EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARGANWHDTHLDYWGQGTLVTVSS (SEQ ID NO: 1122) | DIQMTQSPSSLSASVGDRVTITCRASQSIVTYLNWYQQKPGKAPKLVIYATTSRASGVPSRFSGSGSGTDFTLTISSLQPEDFATYYCQQSYNLPLTFGGGTKVEIK (SEQ ID NO: 1301) |
| 373_A03 | EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARGANWHDTHLDYWGQGTLVTVSS (SEQ ID NO: 1123) | DIQMTQSPSSLSASVGDRVTITCRASQSILSYLNWYQQKPGKAPKLVIYAATSRASGVPSRFSGSGSGTDFTLTISSLQPEDFATYYCQQSYDNPLTFGGGTKVEIK (SEQ ID NO: 1302) |
| 373_A05 | EVQLLESGGGLVQPGGSLRLSCAASGFTFSDYSMNWVRQAPGKGLEWVSGINYNSGYKSYADSVKGRFTISRDNSKNTLYLQMNSLRAEDTAVYYCARGANWHDTHLDYWGQGTLVTVSS (SEQ ID NO: 1124) | DIQMTQSPSSLSASVGDRVTITCRASQSILSYVNWYQQKPGKAPKLVIYAATSRHSGVPSRFSGSGSGTDFTLTISSLQPEDFATYYCQQSYESPLTFGGGTKVEIK (SEQ ID NO: 1303) |
| 373_A09 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1125) | DIQMTQSPSSLSASVGDRVTITCRASQSILTYLNWYQQKPGKAPKLLIYAATSLASGVPSRFSGSGSGTDFTLTISSLQPEDFATYYCQQSYDTPLTFGGGTKVEIK (SEQ ID NO: 1304) |

TABLE 2C-continued

Group III Antibody Sequences

| Ab | VH sequence | VL sequence |
|---|---|---|
| 373_A11 | EVQLLESGGGLVQPGGSLRLSCAASGFTFSNYGMNWVRQAPGKGLEWVANINYNGGYTYADSVKGRFTISRDNSKNTLYLQMNSLRAEDTAVYYCARGANWHDTALDYWGQGTLVTVSS (SEQ ID NO: 1126) | DIQMTQSPSSLSASVGDRVTITCRASQSILTYLNWYQQKPGKAPKLLIYAATSRASGVPSRFSGSGSGTDFTLTISSLQPEDFATYYCQQSYDLPLTFGGGTKVEIK (SEQ ID NO: 1305) |
| 373_A12 | EVQLLESGGGLVQPGGSLRLSCAASGFTFSSYSMNWVRQAPGKGLEWVSSINYNGGYTSYADSVKGRFTISRDNSKNTLYLQMNSLRAEDTAVYYCARGANWHDTALDYWGQGTLVTVSS (SEQ ID NO: 1127) | DIQMTQSPSSLSASVGDRVTITCRASQSILTYLNWYQQKPGKAPKLVIYAATSRASGVPSRFSGSGSGTDFTLTISSLQPEDFATYYCQQSYDTPLTFGGGTKVEIK (SEQ ID NO: 1306) |
| 373_B05 | EVQLLESGGGLVQPGGSLRLSCAASGFTFSDYSMNWVRQAPGKGLEWVSNINYNGGYKSYADSVKGRFTISRDNSKNTLYLQMNSLRAEDTAVYYCARGANWHDTALDYWGQGTLVTVSS (SEQ ID NO: 1128) | DIQMTQSPSSLSASVGDRVTITCRASQSIVTYLNWYQQKPGKAPKLVIYAATSRASGVPSRFSGSGSGTDFTLTISSLQPEDFATYYCQQSYSNPLTFGGGTKVEIK (SEQ ID NO: 1307) |
| 373_B07 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1129) | DIQMTQSPSSLSASVGDRVTITCRASQSILTYVNWYQQKPGKAPKLVIYAATSRASGVPSRFSGSGSGTDFTLTISSLQPEDFATYYCQQSYELPLTFGGGTKVEIK (SEQ ID NO: 1308) |
| 373_C03 | EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGANWHDTALDYWGQGTLVTVSS (SEQ ID NO: 1130) | DIQMTQSPSSLSASVGDRVTITCRASQSIVTYLNWYQQKPGKAPKLVIYAATSRASGVPSRFSGSGSGTDFTLTISSLQPEDFATYYCQQSYDSPLTFGGGTKVEIK (SEQ ID NO: 1309) |
| 373_C07 | EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARGANWHDTHLDYWGQGTLVTVSS (SEQ ID NO: 1131) | DIQMTQSPSSLSASVGDRVTITCRASQSILTYLNWYQQKPGKAPKLVIYAATSRASGVPSRFSGSGSGTDFTLTISSLQPEDFATYYCQQSYETPLTFGGGTKVEIK (SEQ ID NO: 1310) |
| 373_C10 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1132) | DIQMTQSPSSLSASVGDRVTITCRASQSILTYVNWYQQKPGKAPKLLIYAATSRASGVPSRFSGSGSGTDFTLTISSLQPEDFATYYCQQSYDNPLTFGGGTKVEIK (SEQ ID NO: 1311) |
| 373_D03 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1133) | DIQMTQSPSSLSASVGDRVTITCRASQSIVSYLNWYQQKPGKAPKLLIYAATSLASGVPSRFSGSGSGTDFTLTISSLQPEDFATYYCQQSYDTPLTFGGGTKVEIK (SEQ ID NO: 1312) |
| 373_D12 | EVQLLESGGGLVQPGGSLRLSCAASGFTFDSYSMNWVRQAPGKGLEWVSSINYNSGYKGYADSVKGRFTISRDNSKNTLYLQMNSLRAEDTAVYYCARGANWHDTHLDYWGQGTLVTVSS (SEQ ID NO: 1134) | DIQMTQSPSSLSASVGDRVTITCRASQSILSYVNWYQQKPGKAPKLLIYAATSRASGVPSRFSGSGSGTDFTLTISSLQPEDFATYYCQQSYSLPLTFGGGTKVEIK (SEQ ID NO: 1313) |
| 373_E10 | EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1135) | DIQMTQSPSSLSASVGDRVTITCRASQSILTYVNWYQQKPGKAPKLVIYAATSRHSGVPSRFSGSGSGTDFTLTISSLQPEDFATYYCQQSYETPLTFGGGTKVEIK (SEQ ID NO: 1314) |
| 373_F08 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1136) | DIQMTQSPSSLSASVGDRVTITCRASQSILTYLNWYQQKPGKAPKLLIYAATSRASGVPSRFSGSGSGTDFTLTISSLQPEDFATYYCQQSYDTPLTFGGGTKVEIK (SEQ ID NO: 1315) |
| 373_F11 | EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCARGANWHDTHLDYWGQGTLVTVSS (SEQ ID NO: 1137) | DIQMTQSPSSLSASVGDRVTITCRASQSIVSYVNWYQQKPGKAPKLLIYAATSRASGVPSRFSGSGSGTDFTLTISSLQPEDFATYYCQQSYNLPLTFGGGTKVEIK (SEQ ID NO: 1316) |

TABLE 2C-continued

Group III Antibody Sequences

| Ab | VH sequence | VL sequence |
|---|---|---|
| 373_F12 | EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARGANWHDTALDYWGQGTLVTVSS (SEQ ID NO: 1138) | DIQMTQSPSSLSASVGDRVTITCRASQSISTYLNWYQQKPGKAPKLVIYAATSRASGVPSRFSGSGSGTDFTLTISSLQPEDFATYYCQQSYETPLTFGGGTKVEIK (SEQ ID NO: 1317) |
| 373_G08 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARGANWHDTALDYWGQGTLVTVSS (SEQ ID NO: 1139) | DIQMTQSPSSLSASVGDRVTITCRASQSILTYLNWYQQKPGKAPKLLIYAATSLASGVPSRFSGSGSGTDFTLTISSLQPEDFATYYCQQSYDSPLTFGGGTKVEIK (SEQ ID NO: 1318) |
| 373_H03 | EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARGANWHDTALDYWGQGTLVTVSS (SEQ ID NO: 1140) | DIQMTQSPSSLSASVGDRVTITCRASQSILSYLNWYQQKPGKAPKLLIYATTSRASGVPSRFSGSGSGTDFTLTISSLQPEDFATYYCQQSYENPLTFGGGTKVEIK (SEQ ID NO: 1319) |
| 373_H07 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTHLDYWGQGTLVTVSS (SEQ ID NO: 1141) | DIQMTQSPSSLSASVGDRVTITCRASQSIVTYLNWYQQKPGKAPKLLIYAASSLQSGVPSRFSGSGSGTDFTLTISSLQPEDFATYYCQQSYDSPLTFGGGTKVEIK (SEQ ID NO: 1320) |
| 373_H09 | EVQLLESGGGLVQPGGSLRLSCAASGFTFSSYGMNWVRQAPGKGLEWVASINYNSGYKSYADSVKGRFTISRDNSKNTLYLQMNSLRAEDTAVYYCARGANWHDTHLDYWGQGTLVTVSS (SEQ ID NO: 1142) | DIQMTQSPSSLSASVGDRVTITCRASQSIITYLNWYQQKPGKAPKLVIYAATSRASGVPSRFSGSGSGTDFTLTISSLQPEDFATYYCQQSDDSPLTFGGGTKVEIK (SEQ ID NO: 1321) |
| 374_A06 | EVQLLESGGGLVQPGGSLRLSCAASGFTFSSYSMNWVRQAPGKGLEWVSSINYNSGYTSYADSVKGRFTISRDNSKNTLYLQMNSLRAEDTAVYYCARGANWHDTHLDYWGQGTLVTVSS (SEQ ID NO: 1143) | DIQMTQSPSSLSASVGDRVTITCRASQSILSYLNWYQQKPGKAPKLVIYAATSRASGVPSRFSGSGSGTDFTLTISSLQPEDFATYYCQQSYDSPLTFGGGTKVEIK (SEQ ID NO: 1322) |
| 374_A09 | EVQLLESGGGLVQPGGSLRLSCAASGFTFSSYSMNWVRQAPGKGLEWVSSINYNGGYKGYADSVKGRFTISRDNSKNTLYLQMNSLRAEDTAVYYCARGANWHDTHLDYWGQGTLVTVSS (SEQ ID NO: 1144) | DIQMTQSPSSLSASVGDRVTITCRASQSILTYVNWYQQKPGKAPKLLIYAATSLASGVPSRFSGSGSGTDFTLTISSLQPEDFATYYCQQSYDSPLTFGGGTKVEIK (SEQ ID NO: 1323) |
| 374_B03 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1145) | DIQMTQSPSSLSASVGDRVTITCRASQSILTYLNWYQQKPGKAPKLVIYAATSRASGVPSRFSGSGSGTDFTLTISSLQPEDFATYYCQQSYDSPLTFGGGTKVEIK (SEQ ID NO: 1324) |
| 374_B05 | EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARGANWHDTALDYWGQGTLVTVSS (SEQ ID NO: 1146) | DIQMTQSPSSLSASVGDRVTITCRASQSIVSYLNWYQQKPGKAPKLLIYAATSRHSGVPSRFSGSGSGTDFTLTISSLQPEDFATYYCQQSYESPLTFGGGTKVEIK (SEQ ID NO: 1325) |
| 374_B08 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1147) | DIQMTQSPSSLSASVGDRVTITCRASQSIVSYVNWYQQKPGKAPKLLIYAATSRHSGVPSRFSGSGSGTDFTLTISSLQPEDFATYYCQQSYELPLTFGGGTKVEIK (SEQ ID NO: 1326) |
| 374_B10 | EVQLLESGGGLVQPGGSLRLSCAASGFTFSSYSMNWVRQAPGKGLEWVSSINYNSGYTSYADSVKGRFTISRDNSKNTLYLQMNSLRAEDTAVYYCARGANWHDTHLDYWGQGTLVTVSS (SEQ ID NO: 1148) | DIQMTQSPSSLSASVGDRVTITCRASQSILTYVNWYQQKPGKAPKLVIYAATSLASGVPSRFSGSGSGTDFTLTISSLQPEDFATYYCQQSYDTPLTFGGGTKVEIK (SEQ ID NO: 1327) |
| 374_C01 | EVQLLESGGGLVQPGGSLRLSCAASGFTFDSYGMNWVRQAPGKGLEWVSGINYNSGYKSYADSVKGRFTISRDNSKNTLYLQMNSLRAEDTAVYYCARGANWHDTALDYWGQGTLVTVSS (SEQ ID NO: 1149) | DIQMTQSPSSLSASVGDRVTITCRASQSILTYLNWYQQKPGKAPKLLIYAATSRASGVPSRFSGSGSGTDFTLTISSLQPEDFATYYCQQSYETPLTFGGGTKVEIK (SEQ ID NO: 1328) |

TABLE 2C-continued

Group III Antibody Sequences

| Ab | VH sequence | VL sequence |
|---|---|---|
| 374_C09 | EVQLLESGGGLVQPGGSLRLSCAASGFTFDSY GMNWVRQAPGKGLEWVSSINYNGGYKGYADSV KGRFTISRDNSKNTLYLQMNSLRAEDTAVYYC ARGANWHDTHLDYWGQGTLVTVSS (SEQ ID NO: 1150) | DIQMTQSPSSLSASVGDRVTITCRASQSIVSYLNWYQQ KPGKAPKLVIYAATSRASGVPSRFSGSGSGTDFTLTIS SLQPEDFATYYCQQSYELPLTFGGGTKVEIK (SEQ ID NO: 1329) |
| 374_C12 | EVQLLESGGGLVQPGGSLRLSCAASGFTFSSY SMNWVRQAPGKGLEWVAGINYNGGYKSYADSV KGRFTISRDNSKNTLYLQMNSLRAEDTAVYYC ARGANWHDTALDYWGQGTLVTVSS (SEQ ID NO: 1151) | DIQMTQSPSSLSASVGDRVTITCRASQSILTYLNWYQQ KPGKAPKLVIYAATSRASGVPSRFSGSGSGTDFTLTIS SLQPEDFATYYCQQSDNSPLTFGGGTKVEIK (SEQ ID NO: 1330) |
| 374_D03 | EVQLLESGGGLVQPGGSLRLSCAASGFTFDSY SMNWVRQAPGKGLEWVAGINYNGGYKSYADSV KGRFTISRDNSKNTLYLQMNSLRAEDTAVYYC ARGANWHDTHLDYWGQGTLVTVSS (SEQ ID NO: 1152) | DIQMTQSPSSLSASVGDRVTITCRASQSIVTYLNWYQQ KPGKAPKLLIYAATSRASGVPSRFSGSGSGTDFTLTIS SLQPEDFATYYCQQSYDTPLTFGGGTKVEIK (SEQ ID NO: 1331) |
| 374_D05 | EVQLLESGGGLVQPGGSLRLSCAASGFTFDSY SMNWVRQAPGKGLEWVSGINYNSGYTGYADSV KGRFTISRDNSKNTLYLQMNSLRAEDTAVYYC ARGANWHDTHLDYWGQGTLVTVSS (SEQ ID NO: 1153) | DIQMTQSPSSLSASVGDRVTITCRASQSILTYLNWYQQ KPGKAPKLLIYAATSRASGVPSRFSGSGSGTDFTLTIS SLQPEDFATYYCQQSYDTPLTFGGGTKVEIK (SEQ ID NO: 1332) |
| 374_D06 | EVQLLESGGGLVQPGGSLRLSCAASGFTFSSY SMNWVRQAPGKGLEWVSGINYNGGYTSYADSV KGRFTISRDNSKNTLYLQMNSLRAEDTAVYYC ARGANWHDTALDYWGQGTLVTVSS (SEQ ID NO: 1154) | DIQMTQSPSSLSASVGDRVTITCRASQSILSYVNWYQQ KPGKAPKLVIYAATSRASGVPSRFSGSGSGTDFTLTIS SLQPEDFATYYCQQSYDSPLTFGGGTKVEIK (SEQ ID NO: 1333) |
| 374_D07 | EVQLLESGGGLVQPGGSLRLSCAASGFTFDSY SMNWVRQAPGKGLEWVSGINYNSGYKSYADSV KGRFTISRDNSKNTLYLQMNSLRAEDTAVYYC ARGANWHDTALDYWGQGTLVTVSS (SEQ ID NO: 1155) | DIQMTQSPSSLSASVGDRVTITCRASQSIVSYLNWYQQ KPGKAPKLVIYAATSLASGVPSRFSGSGSGTDFTLTIS SLQPEDFATYYCQQSYNSPLTFGGGTKVEIK (SEQ ID NO: 1334) |
| 374_D10 | EVQLLESGGGLVQPGGSLRLSCAASGFTFSSY GMHWVRQAPGKGLEWVASINYNGGYTSYADSV KGRFTISRDNSKNTLYLQMNSLRAEDTAVYYC ARGANWHDTHLDYWGQGTLVTVSS (SEQ ID NO: 1156) | DIQMTQSPSSLSASVGDRVTITCRASQSILTYVNWYQQ KPGKAPKLLIYAATSRASGVPSRFSGSGSGTDFTLTIS SLQPEDFATYYCQQSYDNPLTFGGGTKVEIK (SEQ ID NO: 1335) |
| 374_E10 | EVQLLESGGGLVQPGGSLRLSCAASGFTFSSY SMNWVRQAPGKGLEWVSGINYNGGYKSYADSV KGRFTISRDNSKNTLYLQMNSLRAEDTAVYYC ARGANWHDTALDYWGQGTLVTVSS (SEQ ID NO: 1157) | DIQMTQSPSSLSASVGDRVTITCRASQSILSYLNWYQQ KPGKAPKLLIYAATSRHSGVPSRFSGSGSGTDFTLTIS SLQPEDFATYYCQQSYDSPLTFGGGTKVEIK (SEQ ID NO: 1336) |
| 374_E12 | EVQLLESGGGLVQPGGSLRLSCAASGFTFSSY SMNWVRQAPGKGLEWVSGINYNGGYKSYADSV KGRFTISRDNSKNTLYLQMNSLRAEDTAVYYC ARGANWHDTALDYWGQGTLVTVSS (SEQ ID NO: 1158) | DIQMTQSPSSLSASVGDRVTITCRASQSILSYLNWYQQ KPGKAPKLVIYAATSRASGVPSRFSGSGSGTDFTLTIS SLQPEDFATYYCQQSYDNPLTFGGGTKVEIK (SEQ ID NO: 1337) |
| 374_F06 | EVQLLESGGGLVQPGGSLRLSCAASGFTFSSY SMNWVRQAPGKGLEWVSGINYNGGYTSYADSV KGRFTISRDNSKNTLYLQMNSLRAEDTAVYYC ARGANWHDTALDYWGQGTLVTVSS (SEQ ID NO: 1159) | DIQMTQSPSSLSASVGDRVTITCRASQSIISYVNWYQQ KPGKAPKLVIYAATSLHSGVPSRFSGSGSGTDFTLTIS SLQPEDFATYYCQQSYSTPLTFGGGTKVEIK (SEQ ID NO: 1338) |
| 374_F07 | EVQLLESGGGLVQPGGSLRLSCAASGFTFDSY SMNWVRQAPGKGLEWVASINYNGGYTGYADSV KGRFTISRDNSKNTLYLQMNSLRAEDTAVYYC ARGANWHDTHLDYWGQGTLVTVSS (SEQ ID NO: 1160) | DIQMTQSPSSLSASVGDRVTITCRASQSILSYLNWYQQ KPGKAPKLVIYAVTSLASGVPSRFSGSGSGTDFTLTIS SLQPEDFATYYCQQSYESPLTFGGGTKVEIK (SEQ ID NO: 1339) |
| 374_F08 | EVQLLESGGGLVQPGGSLRLSCAASGFTFSSY SMNWVRQAPGKGLEWVSGINYNGGYKSYADSV KGRFTISRDNSKNTLYLQMNSLRAEDTAVYYC ARGANWHDTALDYWGQGTLVTVSS (SEQ ID NO: 1161) | DIQMTQSPSSLSASVGDRVTITCRASQSILTYVNWYQQ KPGKAPKLVIYAVTSRASGVPSRFSGSGSGTDFTLTIS SLQPEDFATYYCQQSYDTPLTFGGGTKVEIK (SEQ ID NO: 1340) |

TABLE 2C-continued

Group III Antibody Sequences

| Ab | VH sequence | VL sequence |
|---|---|---|
| 374_G03 | EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1162) | DIQMTQSPSSLSASVGDRVTITCRASQSISSYLNWYQQKPGKAPKLVIYAATSRASGVPSRFSGSGSGTDFTLTISSLQPEDFATYYCQQSDDTPLTFGGGTKVEIK (SEQ ID NO: 1341) |
| 374_G08 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1163) | DIQMTQSPSSLSASVGDRVTITCRASQSILTYVNWYQQKPGKAPKLVIYAATSRASGVPSRFSGSGSGTDFTLTISSLQPEDFATYYCQQSYDSPLTFGGGTKVEIK (SEQ ID NO: 1342) |
| 374_G09 | EVQLLESGGGLVQPGGSLRLSCAASGFTFSSYSMNWVRQAPGKGLEWVAGINYNGGYKGYADSVKGRFTISRDNSKNTLYLQMNSLRAEDTAVYYCARGANWHDTHLDYWGQGTLVTVSS (SEQ ID NO: 1164) | DIQMTQSPSSLSASVGDRVTITCRASQSIVRYLNWYQQKPGKAPKLVIYAATSLASGVPSRFSGSGSGTDFTLTISSLQPEDFATYYCQQSYELPLTFGGGTKVEIK (SEQ ID NO: 1343) |
| 374_G10 | EVQLLESGGGLVQPGGSLRLSCAASGFTFSSYSMNWVRQAPGKGLEWVSSINYNSGYTSYADSVKGRFTISRDNSKNTLYLQMNSLRAEDTAVYYCARGANWHDTHLDYWGQGTLVTVSS (SEQ ID NO: 1165) | DIQMTQSPSSLSASVGDRVTITCRASQSIVSYLNWYQQKPGKAPKLVIYAVTSRASGVPSRFSGSGSGTDFTLTISSLQPEDFATYYCQQSYDSPLTFGGGTKVEIK (SEQ ID NO: 1344) |
| 374_G11 | EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1166) | DIQMTQSPSSLSASVGDRVTITCRASQSIISYVNWYQQKPGKAPKLVIYAATSLASGVPSRFSGSGSGTDFTLTISSLQPEDFATYYCQQSYDSPLTFGGGTKVEIK (SEQ ID NO: 1345) |
| 374_H01 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTHLDYWGQGTLVTVSS (SEQ ID NO: 1167) | DIQMTQSPSSLSASVGDRVTITCRASQSILSYLNWYQQKPGKAPKLVIYAATSLASGVPSRFSGSGSGTDFTLTISSLQPEDFATYYCQQSYENPLTFGGGTKVEIK (SEQ ID NO: 1346) |
| 374_H11 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1168) | DIQMTQSPSSLSASVGDRVTITCRASQSIISYVNWYQQKPGKAPKLVIYAATSLHSGVPSRFSGSGSGTDFTLTISSLQPEDFATYYCQQSYSNPLTFGGGTKVEIK (SEQ ID NO: 1347) |
| 375_A01 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1169) | DIQMTQSPSSLSASVGDRVTITCRASQSILSYLNWYQQKPGKAPKLVIYAATSRASGVPSRFSGSGSGTDFTLTISSLQPEDFATYYCQQSYNTPLTFGGGTKVEIK (SEQ ID NO: 1348) |
| 375_A07 | EVQLLESGGGLVQPGGSLRLSCAASGFTFDSYSMNWVRQAPGKGLEWVSSINYNSGYTGYADSVKGRFTISRDNSKNTLYLQMNSLRAEDTAVYYCARGANWHDTHLDYWGQGTLVTVSS (SEQ ID NO: 1170) | DIQMTQSPSSLSASVGDRVTITCRASQSILTYLNWYQQKPGKAPKLLIYAATSRASGVPSRFSGSGSGTDFTLTISSLQPEDFATYYCQQSYDTPLTFGGGTKVEIK (SEQ ID NO: 1349) |
| 375_A08 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARGANWHDTALDYWGQGTLVTVSS (SEQ ID NO: 1171) | DIQMTQSPSSLSASVGDRVTITCRASQSIVTYLNWYQQKPGKAPKLLIYAATSRASGVPSRFSGSGSGTDFTLTISSLQPEDFATYYCQQSYESPLTFGGGTKVEIK (SEQ ID NO: 1350) |
| 375_A12 | EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARGANWHDTALDYWGQGTLVTVSS (SEQ ID NO: 1172) | DIQMTQSPSSLSASVGDRVTITCRASQSILSYLNWYQQKPGKAPKLVIYAVTSRASGVPSRFSGSGSGTDFTLTISSLQPEDFATYYCQQSYETPLTFGGGTKVEIK (SEQ ID NO: 1351) |
| 375_B12 | EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARGANWHDTALDYWGQGTLVTVSS (SEQ ID NO: 1173) | DIQMTQSPSSLSASVGDRVTITCRASQSIVTYLNWYQQKPGKAPKLLIYAATSRASGVPSRFSGSGSGTDFTLTISSLQPEDFATYYCQQSYDTPLTFGGGTKVEIK (SEQ ID NO: 1352) |

TABLE 2C-continued

Group III Antibody Sequences

| Ab | VH sequence | VL sequence |
|---|---|---|
| 375_C04 | EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1174) | DIQMTQSPSSLSASVGDRVTITCRASQSILTYLNWYQQKPGKAPKLVIYAATSRASGVPSRFSGSGSGTDFTLTISSLQPEDFATYYCQQSYESPLTFGGGTKVEIK (SEQ ID NO: 1353) |
| 375_D01 | EVQLLESGGGLVQPGGSLRLSCAASGFTFSSYSMNWVRQAPGKGLEWVSGINYNGGYTGYADSVKGRFTISRDNSKNTLYLQMNSLRAEDTAVYYCARGANWHDTALDYWGQGTLVTVSS (SEQ ID NO: 1175) | DIQMTQSPSSLSASVGDRVTITCRASQSILTYLNWYQQKPGKAPKLVIYAATSRASGVPSRFSGSGSGTDFTLTISSLQPEDFATYYCQQSYETPLTFGGGTKVEIK (SEQ ID NO: 1354) |
| 375_D10 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1176) | DIQMTQSPSSLSASVGDRVTITCRASQSILTYVNWYQQKPGKAPKLLIYAATSRASGVPSRFSGSGSGTDFTLTISSLQPEDFATYYCQQSDDSPLTFGGGTKVEIK (SEQ ID NO: 1355) |
| 375_E02 | EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1177) | DIQMTQSPSSLSASVGDRVTITCRASQSILTYLNWYQQKPGKAPKLLIYAATSRASGVPSRFSGSGSGTDFTLTISSLQPEDFATYYCQQSYSSPLTFGGGTKVEIK (SEQ ID NO: 1356) |
| 375_E03 | EVQLLESGGGLVQPGGSLRLSCAASGFTFSDYSMNWVRQAPGKGLEWVANINYNGGYTSYADSVKGRFTISRDNSKNTLYLQMNSLRAEDTAVYYCARGANWHDTHLDYWGQGTLVTVSS (SEQ ID NO: 1178) | DIQMTQSPSSLSASVGDRVTITCRASQSILTYLNWYQQKPGKAPKLVIYAATSLASGVPSRFSGSGSGTDFTLTISSLQPEDFATYYCQQSYDNPLTFGGGTKVEIK (SEQ ID NO: 1357) |
| 375_E05 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1179) | DIQMTQSPSSLSASVGDRVTITCRASQSILSYLNWYQQKPGKAPKLVIYAATSLASGVPSRFSGSGSGTDFTLTISSLQPEDFATYYCQQSYSSPLTFGGGTKVEIK (SEQ ID NO: 1358) |
| 375_E06 | EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGANWHDTALDYWGQGTLVTVSS (SEQ ID NO: 1180) | DIQMTQSPSSLSASVGDRVTITCRASQSILSYLNWYQQKPGKAPKLVIYAATSRASGVPSRFSGSGSGTDFTLTISSLQPEDFATYYCQQSYDSPLTFGGGTKVEIK (SEQ ID NO: 1359) |
| 375_E10 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1181) | DIQMTQSPSSLSASVGDRVTITCRASQSILSYLNWYQQKPGKAPKLVIYAATSRASGVPSRFSGSGSGTDFTLTISSLQPEDFATYYCQQSYDNPLTFGGGTKVEIK (SEQ ID NO: 1360) |
| 375_F02 | EVQLLESGGGLVQPGGSLRLSCAASGFTFSSYSMNWVRQAPGKGLEWVASINYNSGYTSYADSVKGRFTISRDNSKNTLYLQMNSLRAEDTAVYYCARGANWHDTHLDYWGQGTLVTVSS (SEQ ID NO: 1182) | DIQMTQSPSSLSASVGDRVTITCRASQSILSYLNWYQQKPGKAPKLLIYAATSRASGVPSRFSGSGSGTDFTLTISSLQPEDFATYYCQQSYDSPLTFGGGTKVEIK (SEQ ID NO: 1361) |
| 375_F07 | EVQLLESGGGLVQPGGSLRLSCAASGFTFSDYSMNWVRQAPGKGLEWVSNINYNGGYTGYADSVKGRFTISRDNSKNTLYLQMNSLRAEDTAVYYCARGANWHDTALDYWGQGTLVTVSS (SEQ ID NO: 1183) | DIQMTQSPSSLSASVGDRVTITCRASQSILSYLNWYQQKPGKAPKLLIYAATSRASGVPSRFSGSGSGTDFTLTISSLQPEDFATYYCQQSYDSPLTFGGGTKVEIK (SEQ ID NO: 1362) |
| 375_F08 | EVQLLESGGGLVQPGGSLRLSCAASGFTFSSYGMNWVRQAPGKGLEWVSSINYNSGYKSYADSVKGRFTISRDNSKNTLYLQMNSLRAEDTAVYYCARGANWHDTHLDYWGQGTLVTVSS (SEQ ID NO: 1184) | DIQMTQSPSSLSASVGDRVTITCRASQSILSYLNWYQQKPGKAPKLLIYAATSRHSGVPSRFSGSGSGTDFTLTISSLQPEDFATYYCQQSYDNPLTFGGGTKVEIK (SEQ ID NO: 1363) |
| 375_G04 | EVQLLESGGGLVQPGGSLRLSCAASGFTFSSYGMNWVRQAPGKGLEWVASINYNSGYTGYADSVKGRFTISRDNSKNTLYLQMNSLRAEDTAVYYCARGANWHDTHLDYWGQGTLVTVSS (SEQ ID NO: 1185) | DIQMTQSPSSLSASVGDRVTITCRASQSIVSYVNWYQQKPGKAPKLLIYAATSLASGVPSRFSGSGSGTDFTLTISSLQPEDFATYYCQQSYDSPLTFGGGTKVEIK (SEQ ID NO: 1364) |

TABLE 2C-continued

Group III Antibody Sequences

| Ab | VH sequence | VL sequence |
|---|---|---|
| 375_G05 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1186) | DIQMTQSPSSLSASVGDRVTITCRASQSIVSYLNWYQQKPGKAPKLLIYAVTSRASGVPSRFSGSGSGTDFTLTISSLQPEDFATYYCQQSYDSPLTFGGGTKVEIK (SEQ ID NO: 1365) |
| 375_H05 | EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARGANWHDTALDYWGQGTLVTVSS (SEQ ID NO: 1187) | DIQMTQSPSSLSASVGDRVTITCRASQSILSYVNWYQQKPGKAPKLLIYAATSRASGVPSRFSGSGSGTDFTLTISSLQPEDFATYYCQQSYDTPLTFGGGTKVEIK (SEQ ID NO: 1366) |
| 375_H07 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS (SEQ ID NO: 1188) | DIQMTQSPSSLSASVGDRVTITCRASQSILSYLNWYQQKPGKAPKLLIYAATSLASGVPSRFSGSGSGTDFTLTISSLQPEDFATYYCQQSYSSPLTFGGGTKVEIK (SEQ ID NO: 1367) |
| 376_A03 | EVQLLESGGGLVQPGGSLRLSCAASGFTFSSYGMNWVRQAPGKGLEWVAGINYNGGYTGYADSVKGRFTISRDNSKNTLYLQMNSLRAEDTAVYYCARGANWHDTALDYWGQGTLVTVSS (SEQ ID NO: 1189) | DIQMTQSPSSLSASVGDRVTITCRASQSILTYLNWYQQKPGKAPKLLIYAATSRASGVPSRFSGSGSGTDFTLTISSLQPEDFATYYCQQSYSTPLTFGGGTKVEIK (SEQ ID NO: 1368) |
| 376_B03 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGANWHDTALDYWGQGTLVTVSS (SEQ ID NO: 1190) | DIQMTQSPSSLSASVGDRVTITCRASQSILSYVNWYQQKPGKAPKLVIYAVTSRHSGVPSRFSGSGSGTDFTLTISSLQPEDFATYYCQQSYDSPLTFGGGTKVEIK (SEQ ID NO: 1369) |
| 376_B10 | EVQLLESGGGLVQPGGSLRLSCAASGFTFSDYSMNWVRQAPGKGLEWVAGINYNGGYKGYADSVKGRFTISRDNSKNTLYLQMNSLRAEDTAVYYCARGANWHDTALDYWGQGTLVTVSS (SEQ ID NO: 1191) | DIQMTQSPSSLSASVGDRVTITCRASQSILSYLNWYQQKPGKAPKLVIYAATSLASGVPSRFSGSGSGTDFTLTISSLQPEDFATYYCQQSYSTPLTFGGGTKVEIK (SEQ ID NO: 1370) |
| 376_C04 | EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARGANWHDTALDYWGQGTLVTVSS (SEQ ID NO: 1192) | DIQMTQSPSSLSASVGDRVTITCRASQSILSYVNWYQQKPGKAPKLLIYAVTSRHSGVPSRFSGSGSGTDFTLTISSLQPEDFATYYCQQSYDNPLTFGGGTKVEIK (SEQ ID NO: 1371) |
| 376_C08 | EVQLLESGGGLVQPGGSLRLSCAASGFTFDSYSMNWVRQAPGKGLEWVAGINYNSGYTGYADSVKGRFTISRDNSKNTLYLQMNSLRAEDTAVYYCARGANWHDTHLDYWGQGTLVTVSS (SEQ ID NO: 1193) | DIQMTQSPSSLSASVGDRVTITCRASQSILSYLNWYQQKPGKAPKLLIYAASSLQSGVPSRFSGSGSGTDFTLTISSLQPEDFATYYCQQSYSTPLTFGGGTKVEIK (SEQ ID NO: 1372) |
| 376_D07 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTHLDYWGQGTLVTVSS (SEQ ID NO: 1194) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 1373) |
| 376_E02 | EVQLLESGGGLVQPGGSLRLSCAASGFTFSSYSMNWVRQAPGKGLEWVAGINYNGGYKGYADSVKGRFTISRDNSKNTLYLQMNSLRAEDTAVYYCARGANWHDTALDYWGQGTLVTVSS (SEQ ID NO: 1195) | DIQMTQSPSSLSASVGDRVTITCRASQSILSYVNWYQQKPGKAPKLVIYAATSRHSGVPSRFSGSGSGTDFTLTISSLQPEDFATYYCQQSDNTPLTFGGGTKVEIK (SEQ ID NO: 1374) |
| 376_E11 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS (SEQ ID NO: 1196) | DIQMTQSPSSLSASVGDRVTITCRASQSILTYVNWYQQKPGKAPKLVIYAATSRASGVPSRFSGSGSGTDFTLTISSLQPEDFATYYCQQSYELPLTFGGGTKVEIK (SEQ ID NO: 1375) |
| 376_F01 | EVQLLESGGGLVQPGGSLRLSCAASGFTFSDYSMNWVRQAPGKGLEWVAGINYNGGYKSYADSVKGRFTISRDNSKNTLYLQMNSLRAEDTAVYYCARGANWHDTALDYWGQGTLVTVSS (SEQ ID NO: 1197) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 1376) |

TABLE 2C-continued

Group III Antibody Sequences

| Ab | VH sequence | VL sequence |
|---|---|---|
| 376_F06 | EVQLLESGGGLVQPGGSLRLSCAASGFTFSSY GMNWVRQAPGKGLEWVSGINYNGGYTGYADSV KGRFTISRDNSKNTLYLQMNSLRAEDTAVYYC ARGANWHDTHLDYWGQGTLVTVSS (SEQ ID NO: 1198) | DIQMTQSPSSLSASVGDRVTITCRASQSILTYVNWYQQ KPGKAPKLVIYAATSRASGVPSRFSGSGSGTDFTLTIS SLQPEDFATYYCQQSYETPLTFGGGTKVEIK (SEQ ID NO: 1377) |
| 376_G05 | EVQLLESGGGLVQPGGSLRLSCAASGFTFSSY SMNWVRQAPGKGLEWVAGINYNGGYTSYADSV KGRFTISRDNSKNTLYLQMNSLRAEDTAVYYC ARGANWHDTALDYWGQGTLVTVSS (SEQ ID NO: 1199) | DIQMTQSPSSLSASVGDRVTITCRASQSIISYVNWYQQ KPGKAPKLVIYAATSRASGVPSRFSGSGSGTDFTLTIS SLQPEDFATYYCQQSYESPLTFGGGTKVEIK (SEQ ID NO: 1378) |
| 376_G06 | EVQLLESGGGLVQPGGSLRLSCAASGFTFSSY GMNWVRQAPGKGLEWVAGINYNGGYTSYADSV KGRFTISRDNSKNTLYLQMNSLRAEDTAVYYC ARGANWHDTHLDYWGQGTLVTVSS (SEQ ID NO: 1200) | DIQMTQSPSSLSASVGDRVTITCRASQSIVSYVNWYQQ KPGKAPKLVIYAATSRASGVPSRFSGSGSGTDFTLTIS SLQPEDFATYYCQQSYNSPLTFGGGTKVEIK (SEQ ID NO: 1379) |
| 376_G10 | EVQLLESGGGLVQPGGSLRLSCAASGFTFDSY GMNWVRQAPGKGLEWVAGINYNGGYTSYADSV KGRFTISRDNSKNTLYLQMNSLRAEDTAVYYC ARGANWHDTALDYWGQGTLVTVSS (SEQ ID NO: 1201) | DIQMTQSPSSLSASVGDRVTITCRASQSILSYVNWYQQ KPGKAPKLLIYAATSRASGVPSRFSGSGSGTDFTLTIS SLQPEDFATYYCQQSYESPLTFGGGTKVEIK (SEQ ID NO: 1380) |
| 376_H01 | EVQLLESGGGLVQPGGSLRLSCAASGFTFSDY SMNWVRQAPGKGLEWVAGINYNGGYKGYADSV KGRFTISRDNSKNTLYLQMNSLRAEDTAVYYC ARGANWHDTALDYWGQGTLVTVSS (SEQ ID NO: 1202) | DIQMTQSPSSLSASVGDRVTITCRASQSILTYLNWYQQ KPGKAPKLLIYAATSRASGVPSRFSGSGSGTDFTLTIS SLQPEDFATYYCQQSYSTPLTFGGGTKVEIK (SEQ ID NO: 1381) |
| 376_H04 | EVQLLESGGGLVQPGGSLRLSCAASGFTFSSY SMNWVRQAPGKGLEWVAGINYNGGYKGYADSV KGRFTISRDNSKNTLYLQMNSLRAEDTAVYYC ARGANWHDTALDYWGQGTLVTVSS (SEQ ID NO: 1203) | DIQMTQSPSSLSASVGDRVTITCRASQSILTYVNWYQQ KPGKAPKLVIYAATSRASGVPSRFSGSGSGTDFTLTIS SLQPEDFATYYCQQSYDLPLTFGGGTKVEIK (SEQ ID NO: 1382) |
| 376_H11 | EVQLLESGGGLVQPGGSLRLSCAASGFTFDSY SMNWVRQAPGKGLEWVSNINYNGGYTGYADSV KGRFTISRDNSKNTLYLQMNSLRAEDTAVYYC ARGANWHDTALDYWGQGTLVTVSS (SEQ ID NO: 1204) | DIQMTQSPSSLSASVGDRVTITCRASQSISRYLNWYQQ KPGKAPKLLIYAVTSLASGVPSRFSGSGSGTDFTLTIS SLQPEDFATYYCQQSYESPLTFGGGTKVEIK (SEQ ID NO: 1383) |

Table 3C provides the amino acid sequences of the CDRs of the antibodies shown in Table 2C.

TABLE 3C

CDR sequences for Group III antibodies

| Ab | HCDR1 | HCDR2 | HCDR3 | LCDR1 | LCDR2 | LCDR3 |
|---|---|---|---|---|---|---|
| 365_C05 | SDYSMN (SEQ ID NO: 5464) | WVSGINYNGGYKG (SEQ ID NO: 5643) | ARGANWHDTHLD (SEQ ID NO: 5822) | LTYLNWY (SEQ ID NO: 6001) | LLIYAATSRH (SEQ ID NO: 6180) | QQSYNSPL (SEQ ID NO: 6359) |
| 365_E10 | DSYSMN (SEQ ID NO: 5465) | WVSSINYNSGYKG (SEQ ID NO: 5644) | ARGANWHDTHLD (SEQ ID NO: 5823) | SSYLNWY (SEQ ID NO: 6002) | LLIYAASSLQ (SEQ ID NO: 6181) | QQSYSTPL (SEQ ID NO: 6360) |
| 365_E12 | SDYGMN (SEQ ID NO: 5466) | WVSNINYNGGYTG (SEQ ID NO: 5645) | ARGANWHDTALD (SEQ ID NO: 5824) | LTYLNWY (SEQ ID NO: 6003) | LLIYAATSRA (SEQ ID NO: 6182) | QQSYETPL (SEQ ID NO: 6361) |
| 365_F02 | SSYSMN (SEQ ID NO: 5467) | WVSGINYNGGYKG (SEQ ID NO: 5646) | ARGANWHDTHLD (SEQ ID NO: 5825) | LTYVNWY (SEQ ID NO: 6004) | LLIYAATSRH (SEQ ID NO: 6183) | QQSYDTPL (SEQ ID NO: 6362) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 365_F03 | DSYSMN (SEQ ID NO: 5468) | WVSSINYNGGYTS (SEQ ID NO: 5647) | ARGANWHDTHLD (SEQ ID NO: 5826) | LSYLNWY (SEQ ID NO: 6005) | LLIYAATSRA (SEQ ID NO: 6184) | QQSYDNPL (SEQ ID NO: 6363) |
| 365_G03 | SSYGMN (SEQ ID NO: 5469) | WVAGINYNSGYKG (SEQ ID NO: 5648) | ARGANWHDTHLD (SEQ ID NO: 5827) | VSYLNWY (SEQ ID NO: 6006) | LLIYAATSRA (SEQ ID NO: 6185) | QQSYNTPL (SEQ ID NO: 6364) |
| 365_G04 | DSYSMN (SEQ ID NO: 5470) | WVAGINYNGGYTG (SEQ ID NO: 5649) | ARGANWHDTHLD (SEQ ID NO: 5828) | VSYVNWY (SEQ ID NO: 6007) | LVIYAATSLA (SEQ ID NO: 6186) | QQSYDTPL (SEQ ID NO: 6365) |
| 365_G05 | SSYGMN (SEQ ID NO: 5471) | WVSGINYNGGYKG (SEQ ID NO: 5650) | ARGANWHDTALD (SEQ ID NO: 5829) | LSYLNWY (SEQ ID NO: 6008) | LVIYAATSLA (SEQ ID NO: 6187) | QQSYENPL (SEQ ID NO: 6366) |
| 365_G09 | SSYSMN (SEQ ID NO: 5472) | WVSGINYNGGYKS (SEQ ID NO: 5651) | ARGANWHDTHLD (SEQ ID NO: 5830) | ITYLNWY (SEQ ID NO: 6009) | LVIYAATSRA (SEQ ID NO: 6188) | QQSYNSPL (SEQ ID NO: 6367) |
| 365_H07 | DSYSMN (SEQ ID NO: 5473) | WVSGINYNGGYTS (SEQ ID NO: 5652) | ARGANWHDTHLD (SEQ ID NO: 5831) | STYVNWY (SEQ ID NO: 6010) | LLIYAATSRH (SEQ ID NO: 6189) | QQSYENPL (SEQ ID NO: 6368) |
| 366_A06 | SDYSMN (SEQ ID NO: 5474) | WVASINYNGGYKS (SEQ ID NO: 5653) | ARGANWHDTHLD (SEQ ID NO: 5832) | SSYLNWY (SEQ ID NO: 6011) | LLIYAASSLQ (SEQ ID NO: 6190) | QQSYSTPL (SEQ ID NO: 6369) |
| 366_A08 | DDYSMN (SEQ ID NO: 5475) | WVSGINYNSGYKG (SEQ ID NO: 5654) | ARGANWHDTHLD (SEQ ID NO: 5833) | VSYVNWY (SEQ ID NO: 6012) | LVIYAATSRA (SEQ ID NO: 6191) | QQSYNSPL (SEQ ID NO: 6370) |
| 366_B05 | SDYSMN (SEQ ID NO: 5476) | WVSGINYNSGYKS (SEQ ID NO: 5655) | ARGANWHDTALD (SEQ ID NO: 5834) | SSYLNWY (SEQ ID NO: 6013) | LVIYAVTSRA (SEQ ID NO: 6192) | QQSYELPL (SEQ ID NO: 6371) |
| 366_B07 | SDYGMN (SEQ ID NO: 5477) | WVSGINYNGGYTS (SEQ ID NO: 5656) | ARGANWHDTHLD (SEQ ID NO: 5835) | VSYLNWY (SEQ ID NO: 6014) | LVIYATTSRA (SEQ ID NO: 6193) | QQSYNSPL (SEQ ID NO: 6372) |
| 366_E01 | DSYGMN (SEQ ID NO: 5478) | WVSNINYNGGYKS (SEQ ID NO: 5657) | ARGANWHDTHLD (SEQ ID NO: 5836) | LTYLNWY (SEQ ID NO: 6015) | LLIYAATSRA (SEQ ID NO: 6194) | QQSYSSPL (SEQ ID NO: 6373) |
| 366_E08 | SDYSMN (SEQ ID NO: 5479) | WVSNINYNGGYTS (SEQ ID NO: 5658) | ARGANWHDTHLD (SEQ ID NO: 5837) | VTYLNWY (SEQ ID NO: 6016) | LLIYAATSRH (SEQ ID NO: 6195) | QQSYSNPL (SEQ ID NO: 6374) |
| 366_F02 | SSYGMN (SEQ ID NO: 5480) | WVSGINYNSGYTG (SEQ ID NO: 5659) | ARGANWHDTHLD (SEQ ID NO: 5838) | LTYLNWY (SEQ ID NO: 6017) | LVIYAATSRH (SEQ ID NO: 6196) | QQSYDNPL (SEQ ID NO: 6375) |
| 366_G12 | SSYGMH (SEQ ID NO: 5481) | WVSGINYNSGYKG (SEQ ID NO: 5660) | ARGANWHDTHLD (SEQ ID NO: 5839) | LSYLNWY (SEQ ID NO: 6018) | LLIYAATSRH (SEQ ID NO: 6197) | QQSYNTPL (SEQ ID NO: 6376) |
| 366_H04 | DSYGMN (SEQ ID NO: 5482) | WVSNINYNGGYKS (SEQ ID NO: 5661) | ARGANWHDTHLD (SEQ ID NO: 5840) | LTYLNWY (SEQ ID NO: 6019) | LLIYAATSRA (SEQ ID NO: 6198) | QQSYSSPL (SEQ ID NO: 6377) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 367_A03 | DSYGMN (SEQ ID NO: 5483) | WVAGINYNGGYTS (SEQ ID NO: 5662) | ARGANWHDTALD (SEQ ID NO: 5841) | LTYVNWY (SEQ ID NO: 6020) | LLIYATTSRH (SEQ ID NO: 6199) | QQSYDSPL (SEQ ID NO: 6378) |
| 367_A06 | DSYGMN (SEQ ID NO: 5484) | WVASINYNGGYKG (SEQ ID NO: 5663) | ARGANWHDTHLD (SEQ ID NO: 5842) | LSYVNWY (SEQ ID NO: 6021) | LLIYAATSRH (SEQ ID NO: 6200) | QQSYDTPL (SEQ ID NO: 6379) |
| 367_A08 | DSYGMN (SEQ ID NO: 5485) | WVAGINYNGGYTS (SEQ ID NO: 5664) | ARGANWHDTHLD (SEQ ID NO: 5843) | LTYLNWY (SEQ ID NO: 6022) | LLIYAVTSRA (SEQ ID NO: 6201) | QQSYDSPL (SEQ ID NO: 6380) |
| 367_A10 | SSYGMN (SEQ ID NO: 5486) | WVAGINYNSGYTS (SEQ ID NO: 5665) | ARGANWHDTHLD (SEQ ID NO: 5844) | ITYVNWY (SEQ ID NO: 6023) | LLIYAATSLA (SEQ ID NO: 6202) | QQSYDLPL (SEQ ID NO: 6381) |
| 367_A12 | SSYGMN (SEQ ID NO: 5487) | WVSGINYNSGYTS (SEQ ID NO: 5666) | ARGANWHDTHLD (SEQ ID NO: 5845) | LSYLNWY (SEQ ID NO: 6024) | LLIYAATSLH (SEQ ID NO: 6203) | QQSYNNPL (SEQ ID NO: 6382) |
| 367_B01 | SSYSMN (SEQ ID NO: 5488) | WVAGINYNGGYKG (SEQ ID NO: 5667) | ARGANWHDTALD (SEQ ID NO: 5846) | SSYVNWY (SEQ ID NO: 6025) | LVIYAATSRA (SEQ ID NO: 6204) | QQSYSTPL (SEQ ID NO: 6383) |
| 367_B04 | DSYSMN (SEQ ID NO: 5489) | WVSGINYNSGYKS (SEQ ID NO: 5668) | ARGANWHDTHLD (SEQ ID NO: 5847) | LSYLNWY (SEQ ID NO: 6026) | LLIYAATSRA (SEQ ID NO: 6205) | QQSYELPL (SEQ ID NO: 6384) |
| 367_B12 | SSYGMH (SEQ ID NO: 5490) | WVASINYNGGYKS (SEQ ID NO: 5669) | ARGANWHDTHLD (SEQ ID NO: 5848) | LSYVNWY (SEQ ID NO: 6027) | LVIYAATSLA (SEQ ID NO: 6206) | QQSYDTPL (SEQ ID NO: 6385) |
| 367_C07 | SSYSMN (SEQ ID NO: 5491) | WVSSINYNSGYTG (SEQ ID NO: 5670) | ARGANWHDTHLD (SEQ ID NO: 5849) | LTYVNWY (SEQ ID NO: 6028) | LLIYAATSRA (SEQ ID NO: 6207) | QQSYNLPL (SEQ ID NO: 6386) |
| 367_C10 | DSYSMN (SEQ ID NO: 5492) | WVSGINYNGGYTS (SEQ ID NO: 5671) | ARGANWHDTALD (SEQ ID NO: 5850) | VSYVNWY (SEQ ID NO: 6029) | LLIYAVTSRA (SEQ ID NO: 6208) | QQSYETPL (SEQ ID NO: 6387) |
| 367_D03 | DSYSMN (SEQ ID NO: 5493) | WVSSINYNGGYTG (SEQ ID NO: 5672) | ARGANWHDTHLD (SEQ ID NO: 5851) | ITYLNWY (SEQ ID NO: 6030) | LLIYAATSRA (SEQ ID NO: 6209) | QQSYDTPL (SEQ ID NO: 6388) |
| 367_D06 | DSYSMN (SEQ ID NO: 5494) | WVAGINYNGGYTS (SEQ ID NO: 5673) | ARGANWHDTHLD (SEQ ID NO: 5852) | STYLNWY (SEQ ID NO: 6031) | LVIYAATSLA (SEQ ID NO: 6210) | QQSYNSPL (SEQ ID NO: 6389) |
| 367_D08 | SDYSMN (SEQ ID NO: 5495) | WVAGINYNGGYTS (SEQ ID NO: 5674) | ARGANWHDTHLD (SEQ ID NO: 5853) | LSYLNWY (SEQ ID NO: 6032) | LVIYAATSRH (SEQ ID NO: 6211) | QQSDDLPL (SEQ ID NO: 6390) |
| 367_D12 | SSYSMN (SEQ ID NO: 5496) | WVSSINYNGGYTG (SEQ ID NO: 5675) | ARGANWHDTHLD (SEQ ID NO: 5854) | VSYVNWY (SEQ ID NO: 6033) | LVIYAATSRA (SEQ ID NO: 6212) | QQSYESPL (SEQ ID NO: 6391) |
| 367_E05 | SSYGMN (SEQ ID NO: 5497) | WVAGINYNGGYTS (SEQ ID NO: 5676) | ARGANWHDTHLD (SEQ ID NO: 5855) | LSYLNWY (SEQ ID NO: 6034) | LLIYAATSRH (SEQ ID NO: 6213) | QQSYDSPL (SEQ ID NO: 6392) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 367_F01 | DSYSMN (SEQ ID NO: 5498) | WVSNINYNGGYKS (SEQ ID NO: 5677) | ARGANWHDTHLD (SEQ ID NO: 5856) | ISYLNWY (SEQ ID NO: 6035) | LLIYAASSLQ (SEQ ID NO: 6214) | QQSYSTPL (SEQ ID NO: 6393) |
| 367_G01 | DSYGMN (SEQ ID NO: 5499) | WVASINYNSGYTG (SEQ ID NO: 5678) | ARGANWHDTHLD (SEQ ID NO: 5857) | SSYLNWY (SEQ ID NO: 6036) | LVIYAATSRA (SEQ ID NO: 6215) | QQSYDLPL (SEQ ID NO: 6394) |
| 367_G04 | SSYSMN (SEQ ID NO: 5500) | WVAGINYNSGYTS (SEQ ID NO: 5679) | ARGANWHDTHLD (SEQ ID NO: 5858) | LSYLNWY (SEQ ID NO: 6037) | LVIYAATSRA (SEQ ID NO: 6216) | QQSYDSPL (SEQ ID NO: 6395) |
| 367_H02 | DSYGMN (SEQ ID NO: 5501) | WVSSINYNGGYTG (SEQ ID NO: 5680) | ARGANWHDTHLD (SEQ ID NO: 5859) | SSYLNWY (SEQ ID NO: 6038) | LLIYAASSLQ (SEQ ID NO: 6217) | QQSYSTPL (SEQ ID NO: 6396) |
| 367_H03 | SSYGMN (SEQ ID NO: 5502) | WVAGINYNSGYTS (SEQ ID NO: 5681) | ARGANWHDTHLD (SEQ ID NO: 5860) | ITYVNWY (SEQ ID NO: 6039) | LLIYAATSLA (SEQ ID NO: 6218) | QQSYDLPL (SEQ ID NO: 6397) |
| 368_A03 | SSYSMN (SEQ ID NO: 5503) | WVSGINYNGGYTG (SEQ ID NO: 5682) | ARGANWHDTHLD (SEQ ID NO: 5861) | ISYLNWY (SEQ ID NO: 6040) | LLIYAVTSRA (SEQ ID NO: 6219) | QQSYENPL (SEQ ID NO: 6398) |
| 368_A04 | DDYSMN (SEQ ID NO: 5504) | WVAGINYNGGYKS (SEQ ID NO: 5683) | ARGANWHDTHLD (SEQ ID NO: 5862) | LTYLNWY (SEQ ID NO: 6041) | LVIYAVTSRA (SEQ ID NO: 6220) | QQSYELPL (SEQ ID NO: 6399) |
| 368_B09 | DSYGMN (SEQ ID NO: 5505) | WVSNINYNGGYKG (SEQ ID NO: 5684) | ARGANWHDTHLD (SEQ ID NO: 5863) | LSYLNWY (SEQ ID NO: 6042) | LLIYAATSRH (SEQ ID NO: 6221) | QQSYDTPL (SEQ ID NO: 6400) |
| 368_C02 | DDYSMN (SEQ ID NO: 5506) | WVANINYNGGYKG (SEQ ID NO: 5685) | ARGANWHDTHLD (SEQ ID NO: 5864) | STYVNWY (SEQ ID NO: 6043) | LLIYAATSLA (SEQ ID NO: 6222) | QQSYSTPL (SEQ ID NO: 6401) |
| 368_C08 | SDYSMN (SEQ ID NO: 5507) | WVSGINYNGGYTS (SEQ ID NO: 5686) | ARGANWHDTHLD (SEQ ID NO: 5865) | LTYVNWY (SEQ ID NO: 6044) | LLIYAASSLQ (SEQ ID NO: 6223) | QQSYSTPL (SEQ ID NO: 6402) |
| 368_E12 | SDYGMN (SEQ ID NO: 5508) | WVAGINYNGGYTS (SEQ ID NO: 5687) | ARGANWHDTHLD (SEQ ID NO: 5866) | VSYVNWY (SEQ ID NO: 6045) | LVIYAVTSRA (SEQ ID NO: 6224) | QQSYDSPL (SEQ ID NO: 6403) |
| 368_F09 | SSYGMN (SEQ ID NO: 5509) | WVSGINYNSGYTS (SEQ ID NO: 5688) | ARGANWHDTHLD (SEQ ID NO: 5867) | LTYLNWY (SEQ ID NO: 6046) | LLIYAASSLQ (SEQ ID NO: 6225) | QQSYETPL (SEQ ID NO: 6404) |
| 368_H02 | SSYGMN (SEQ ID NO: 5510) | WVAGINYNSGYTS (SEQ ID NO: 5689) | ARGANWHDTALD (SEQ ID NO: 5868) | VTYLNWY (SEQ ID NO: 6047) | LVIYAATSRA (SEQ ID NO: 6226) | QQSYESPL (SEQ ID NO: 6405) |
| 368_H05 | SSYSMN (SEQ ID NO: 5511) | WVANINYNGGYKS (SEQ ID NO: 5690) | ARGANWHDTHLD (SEQ ID NO: 5869) | VSYVNWY (SEQ ID NO: 6048) | LVIYATTSRA (SEQ ID NO: 6227) | QQSYESPL (SEQ ID NO: 6406) |
| 369_A07 | SSYSMN (SEQ ID NO: 5512) | WVAGINYNGGYKG (SEQ ID NO: 5691) | ARGANWHDTALD (SEQ ID NO: 5870) | LSYLNWY (SEQ ID NO: 6049) | LVIYAATSRA (SEQ ID NO: 6228) | QQSYESPL (SEQ ID NO: 6407) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 369_B05 | DSYSMN (SEQ ID NO: 5513) | WVSGINYNGGYKS (SEQ ID NO: 5692) | ARGANWHDTHLD (SEQ ID NO: 5871) | ISYLNWY (SEQ ID NO: 6050) | LLIYAATSLA (SEQ ID NO: 6229) | QQSYDTPL (SEQ ID NO: 6408) |
| 369_C05 | DSYSMN (SEQ ID NO: 5514) | WVAGINYNGGYTS (SEQ ID NO: 5693) | ARGANWHDTALD (SEQ ID NO: 5872) | SSYVNWY (SEQ ID NO: 6051) | LVIYATTSRH (SEQ ID NO: 6230) | QQSYNSPL (SEQ ID NO: 6409) |
| 369_D03 | SSYSMN (SEQ ID NO: 5515) | WVSGINYNGGYTS (SEQ ID NO: 5694) | ARGANWHDTHLD (SEQ ID NO: 5873) | LTYLNWY (SEQ ID NO: 6052) | LVIYAATSRA (SEQ ID NO: 6231) | QQSYENPL (SEQ ID NO: 6410) |
| 369_D07 | SSYGMN (SEQ ID NO: 5516) | WVSGINYNGGYKS (SEQ ID NO: 5695) | ARGANWHDTHLD (SEQ ID NO: 5874) | VSYLNWY (SEQ ID NO: 6053) | LVIYAATSRA (SEQ ID NO: 6232) | QQSYDLPL (SEQ ID NO: 6411) |
| 369_D09 | SDYGMN (SEQ ID NO: 5517) | WVSNINYNGGYTS (SEQ ID NO: 5696) | ARGANWHDTALD (SEQ ID NO: 5875) | LTYLNWY (SEQ ID NO: 6054) | LLIYAATSRA (SEQ ID NO: 6233) | QQSYDSPL (SEQ ID NO: 6412) |
| 369_E06 | SSYGMN (SEQ ID NO: 5518) | WVSGINYNGGYTS (SEQ ID NO: 5697) | ARGANWHDTALD (SEQ ID NO: 5876) | ISYLNWY (SEQ ID NO: 6055) | LVIYAATSRH (SEQ ID NO: 6234) | QQSYDSPL (SEQ ID NO: 6413) |
| 369_F08 | SDYGMH (SEQ ID NO: 5519) | WVSGINYNSGYTS (SEQ ID NO: 5698) | ARGANWHDTALD (SEQ ID NO: 5877) | LSYLNWY (SEQ ID NO: 6056) | LLIYAASSLQ (SEQ ID NO: 6235) | QQSYDLPL (SEQ ID NO: 6414) |
| 369_G08 | DSYSMN (SEQ ID NO: 5520) | WVSSINYNGGYKG (SEQ ID NO: 5699) | ARGANWHDTHLD (SEQ ID NO: 5878) | LTYLNWY (SEQ ID NO: 6057) | LLIYAASSLQ (SEQ ID NO: 6236) | QQSYSTPL (SEQ ID NO: 6415) |
| 370_A02 | DSYGMN (SEQ ID NO: 5521) | WVAGINYNGGYTG (SEQ ID NO: 5700) | ARGANWHDTALD (SEQ ID NO: 5879) | VTYLNWY (SEQ ID NO: 6058) | LVIYAATSRA (SEQ ID NO: 6237) | QQSYDSPL (SEQ ID NO: 6416) |
| 370_B03 | SSYSMN (SEQ ID NO: 5522) | WVANINYNGGYTG (SEQ ID NO: 5701) | ARGANWHDTALD (SEQ ID NO: 5880) | LSYLNWY (SEQ ID NO: 6059) | LVIYAATSRA (SEQ ID NO: 6238) | QQSYNNPL (SEQ ID NO: 6417) |
| 370_B11 | DSYSMN (SEQ ID NO: 5523) | WVSGINYNSGYTS (SEQ ID NO: 5702) | ARGANWHDTHLD (SEQ ID NO: 5881) | LSYLNWY (SEQ ID NO: 6060) | LVIYAATSRH (SEQ ID NO: 6239) | QQGYDLPL (SEQ ID NO: 6418) |
| 370_B12 | SDYSMN (SEQ ID NO: 5524) | WVSGINYNGGYKG (SEQ ID NO: 5703) | ARGANWHDTALD (SEQ ID NO: 5882) | LSYVNWY (SEQ ID NO: 6061) | LVIYATTSRA (SEQ ID NO: 6240) | QQSYETPL (SEQ ID NO: 6419) |
| 370_D01 | SSYSMN (SEQ ID NO: 5525) | WVSSINYNGGYTG (SEQ ID NO: 5704) | ARGANWHDTALD (SEQ ID NO: 5883) | LSYLNWY (SEQ ID NO: 6062) | LLIYAATSRH (SEQ ID NO: 6241) | QQSYNTPL (SEQ ID NO: 6420) |
| 370_D05 | DDYSMN (SEQ ID NO: 5526) | WVSNINYNGGYKG (SEQ ID NO: 5705) | ARGANWHDTALD (SEQ ID NO: 5884) | ITYLNWY (SEQ ID NO: 6063) | LVIYAATSRH (SEQ ID NO: 6242) | QQSYDTPL (SEQ ID NO: 6421) |
| 370_F03 | SSYGMN (SEQ ID NO: 5527) | WVSSINYNSGYKS (SEQ ID NO: 5706) | ARGANWHDTALD (SEQ ID NO: 5885) | LSYVNWY (SEQ ID NO: 6064) | LLIYAATSRA (SEQ ID NO: 6243) | QQSYENPL (SEQ ID NO: 6422) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 370_H02 | DSYSMN (SEQ ID NO: 5528) | WVSGINYNSGYTS (SEQ ID NO: 5707) | ARGANWHDTHLD (SEQ ID NO: 5886) | LTYLNWY (SEQ ID NO: 6065) | LLIYAATSRA (SEQ ID NO: 6244) | QQSYESPL (SEQ ID NO: 6423) |
| 370_H07 | SSYSMN (SEQ ID NO: 5529) | WVAGINYNGGYKS (SEQ ID NO: 5708) | ARGANWHDTALD (SEQ ID NO: 5887) | LSYLNWY (SEQ ID NO: 6066) | LLIYAATSLA (SEQ ID NO: 6245) | QQSDSSPL (SEQ ID NO: 6424) |
| 371_A10 | DDYSMN (SEQ ID NO: 5530) | WVSGINYNGGYKG (SEQ ID NO: 5709) | ARGANWHDTALD (SEQ ID NO: 5888) | VSYLNWY (SEQ ID NO: 6067) | LVIYAATSRA (SEQ ID NO: 6246) | QQSYENPL (SEQ ID NO: 6425) |
| 371_B03 | SSYGMH (SEQ ID NO: 5531) | WVASINYNGGYTS (SEQ ID NO: 5710) | ARGANWHDTHLD (SEQ ID NO: 5889) | LSYVNWY (SEQ ID NO: 6068) | LLIYATTSRA (SEQ ID NO: 6247) | QQSYDNPL (SEQ ID NO: 6426) |
| 371_B04 | SSYSMN (SEQ ID NO: 5532) | WVSGINYNGGYKS (SEQ ID NO: 5711) | ARGANWHDTALD (SEQ ID NO: 5890) | LSYLNWY (SEQ ID NO: 6069) | LVIYAVTSRH (SEQ ID NO: 6248) | QQSYDSPL (SEQ ID NO: 6427) |
| 371_B09 | SSYSMN (SEQ ID NO: 5533) | WVAGINYNSGYTG (SEQ ID NO: 5712) | ARGANWHDTHLD (SEQ ID NO: 5891) | LSYVNWY (SEQ ID NO: 6070) | LVIYATTSLA (SEQ ID NO: 6249) | QQSYDTPL (SEQ ID NO: 6428) |
| 371_B12 | SDYSMN (SEQ ID NO: 5534) | WVAGINYNSGYTS (SEQ ID NO: 5713) | ARGANWHDTALD (SEQ ID NO: 5892) | VTYLNWY (SEQ ID NO: 6071) | LVIYAATSRH (SEQ ID NO: 6250) | QQSYNNPL (SEQ ID NO: 6429) |
| 371_C01 | SSYGMH (SEQ ID NO: 5535) | WVSSINYNGGYTG (SEQ ID NO: 5714) | ARGANWHDTHLD (SEQ ID NO: 5893) | VSYLNWY (SEQ ID NO: 6072) | LLIYAATSRH (SEQ ID NO: 6251) | QQSYDNPL (SEQ ID NO: 6430) |
| 371_C04 | DSYGMN (SEQ ID NO: 5536) | WVSGINYNSGYKG (SEQ ID NO: 5715) | ARGANWHDTALD (SEQ ID NO: 5894) | LSYLNWY (SEQ ID NO: 6073) | LLIYAATSRA (SEQ ID NO: 6252) | QQSYSTPL (SEQ ID NO: 6431) |
| 371_C05 | SDYGMH (SEQ ID NO: 5537) | WVANINYNGGYTG (SEQ ID NO: 5716) | ARGANWHDTALD (SEQ ID NO: 5895) | LSYLNWY (SEQ ID NO: 6074) | LLIYAATSRA (SEQ ID NO: 6253) | QQSYDSPL (SEQ ID NO: 6432) |
| 371_C12 | SSYSMN (SEQ ID NO: 5538) | WVAGINYNSGYKS (SEQ ID NO: 5717) | ARGANWHDTHLD (SEQ ID NO: 5896) | VSYVNWY (SEQ ID NO: 6075) | LLIYAATSRA (SEQ ID NO: 6254) | QQSYDTPL (SEQ ID NO: 6433) |
| 371_D02 | DDYSMN (SEQ ID NO: 5539) | WVAGINYNGGYKS (SEQ ID NO: 5718) | ARGANWHDTALD (SEQ ID NO: 5897) | VTYLNWY (SEQ ID NO: 6076) | LLIYAATSRA (SEQ ID NO: 6255) | QQSYDSPL (SEQ ID NO: 6434) |
| 371_D04 | DDYSMN (SEQ ID NO: 5540) | WVAGINYNGGYTG (SEQ ID NO: 5719) | ARGANWHDTHLD (SEQ ID NO: 5898) | VSYVNWY (SEQ ID NO: 6077) | LLIYAATSLA (SEQ ID NO: 6256) | QQSYENPL (SEQ ID NO: 6435) |
| 371_E06 | SSYSMN (SEQ ID NO: 5541) | WVSGINYNGGYTS (SEQ ID NO: 5720) | ARGANWHDTALD (SEQ ID NO: 5899) | STYLNWY (SEQ ID NO: 6078) | LLIYAVTSLH (SEQ ID NO: 6257) | QQSYESPL (SEQ ID NO: 6436) |
| 371_E07 | DSYSMN (SEQ ID NO: 5542) | WVAGINYNGGYTS (SEQ ID NO: 5721) | ARGANWHDTALD (SEQ ID NO: 5900) | ISYLNWY (SEQ ID NO: 6079) | LLIYAATSLA (SEQ ID NO: 6258) | QQSYESPL (SEQ ID NO: 6437) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 371_E10 | DSYSMN (SEQ ID NO: 5543) | WVAGINYNGGYTS (SEQ ID NO: 5722) | ARGANWHDTALD (SEQ ID NO: 5901) | STYLNWY (SEQ ID NO: 6080) | LLIYAVTSRA (SEQ ID NO: 6259) | QQSYNSPL (SEQ ID NO: 6438) |
| 371_F10 | DSYGMN (SEQ ID NO: 5544) | WVSGINYNSGYTS (SEQ ID NO: 5723) | ARGANWHDTALD (SEQ ID NO: 5902) | SSYLNWY (SEQ ID NO: 6081) | LVIYAVTSRA (SEQ ID NO: 6260) | QQSYESPL (SEQ ID NO: 6439) |
| 371_F11 | SSYSMN (SEQ ID NO: 5545) | WVSGINYNGGYTS (SEQ ID NO: 5724) | ARGANWHDTALD (SEQ ID NO: 5903) | ISYVNWY (SEQ ID NO: 6082) | LLIYAVTSRA (SEQ ID NO: 6261) | QQSYDLPL (SEQ ID NO: 6440) |
| 371_G02 | DSYGMN (SEQ ID NO: 5546) | WVASINYNGGYTS (SEQ ID NO: 5725) | ARGANWHDTHLD (SEQ ID NO: 5904) | LSYLNWY (SEQ ID NO: 6083) | LLIYAATSRA (SEQ ID NO: 6262) | QQSYDLPL (SEQ ID NO: 6441) |
| 371_G04 | DSYSMN (SEQ ID NO: 5547) | WVSGINYNGGYKS (SEQ ID NO: 5726) | ARGANWHDTALD (SEQ ID NO: 5905) | LSYLNWY (SEQ ID NO: 6084) | LLIYAATSLH (SEQ ID NO: 6263) | QQSYESPL (SEQ ID NO: 6442) |
| 371_G09 | SSYSMN (SEQ ID NO: 5548) | WVANINYNGGYTG (SEQ ID NO: 5727) | ARGANWHDTALD (SEQ ID NO: 5906) | LSYLNWY (SEQ ID NO: 6085) | LVIYAATSRA (SEQ ID NO: 6264) | QQSDSTPL (SEQ ID NO: 6443) |
| 371_G11 | SSYGMN (SEQ ID NO: 5549) | WVSNINYNSGYTS (SEQ ID NO: 5728) | ARGANWHDTALD (SEQ ID NO: 5907) | LSYVNWY (SEQ ID NO: 6086) | LLIYAATSLA (SEQ ID NO: 6265) | QQSYDSPL (SEQ ID NO: 6444) |
| 371_H04 | SSYGMN (SEQ ID NO: 5550) | WVSNINYNGGYTG (SEQ ID NO: 5729) | ARGANWHDTALD (SEQ ID NO: 5908) | LTYLNWY (SEQ ID NO: 6087) | LLIYAATSRA (SEQ ID NO: 6266) | QQSYNSPL (SEQ ID NO: 6445) |
| 371_H05 | SSYGMN (SEQ ID NO: 5551) | WVSGINYNSGYKS (SEQ ID NO: 5730) | ARGANWHDTALD (SEQ ID NO: 5909) | ISYLNWY (SEQ ID NO: 6088) | LLIYAATSLA (SEQ ID NO: 6267) | QQSYSLPL (SEQ ID NO: 6446) |
| 371_H06 | DSYGMN (SEQ ID NO: 5552) | WVSGINYNGGYTS (SEQ ID NO: 5731) | ARGANWHDTALD (SEQ ID NO: 5910) | SSYLNWY (SEQ ID NO: 6089) | LVIYAVTSRA (SEQ ID NO: 6268) | QQSYDLPL (SEQ ID NO: 6447) |
| 371_H08 | SSYGMN (SEQ ID NO: 5553) | WVASINYNGGYKG (SEQ ID NO: 5732) | ARGANWHDTHLD (SEQ ID NO: 5911) | ISYVNWY (SEQ ID NO: 6090) | LVIYAVTSRA (SEQ ID NO: 6269) | QQSYDTPL (SEQ ID NO: 6448) |
| 371_H10 | SSYSMN (SEQ ID NO: 5554) | WVAGINYNSGYKS (SEQ ID NO: 5733) | ARGANWHDTHLD (SEQ ID NO: 5912) | STYLNWY (SEQ ID NO: 6091) | LLIYAATSRH (SEQ ID NO: 6270) | QQSYENPL (SEQ ID NO: 6449) |
| 372_B02 | SSYSMN (SEQ ID NO: 5555) | WVSGINYNSGYTS (SEQ ID NO: 5734) | ARGANWHDTALD (SEQ ID NO: 5913) | LSYVNWY (SEQ ID NO: 6092) | LLIYAVTSLA (SEQ ID NO: 6271) | QQSYETPL (SEQ ID NO: 6450) |
| 372_C06 | SDYSMN (SEQ ID NO: 5556) | WVSGINYNGGYTS (SEQ ID NO: 5735) | ARGANWHDTALD (SEQ ID NO: 5914) | VSYVNWY (SEQ ID NO: 6093) | LLIYAATSRA (SEQ ID NO: 6272) | QQSYSSPL (SEQ ID NO: 6451) |
| 372_D03 | SSYSMN (SEQ ID NO: 5557) | WVAGINYNSGYKS (SEQ ID NO: 5736) | ARGANWHDTALD (SEQ ID NO: 5915) | LSYVNWY (SEQ ID NO: 6094) | LVIYAVTSRH (SEQ ID NO: 6273) | QQSYDSPL (SEQ ID NO: 6452) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 372_E01 | DDYSMN (SEQ ID NO: 5558) | WVSGINYNGGYKG (SEQ ID NO: 5737) | ARGANWHDTALD (SEQ ID NO: 5916) | VSYLNWY (SEQ ID NO: 6095) | LVIYAATSRH (SEQ ID NO: 6274) | QQSYDSPL (SEQ ID NO: 6453) |
| 372_G12 | DSYSMN (SEQ ID NO: 5559) | WVAGINYNGGYTG (SEQ ID NO: 5738) | ARGANWHDTHLD (SEQ ID NO: 5917) | LTYLNWY (SEQ ID NO: 6096) | LVIYAATSRH (SEQ ID NO: 6275) | QQSYDSPL (SEQ ID NO: 6454) |
| 373_A01 | SSYGMN (SEQ ID NO: 5560) | WVSNINYNGGYTG (SEQ ID NO: 5739) | ARGANWHDTHLD (SEQ ID NO: 5918) | VTYLNWY (SEQ ID NO: 6097) | LVIYATTSRA (SEQ ID NO: 6276) | QQSYNLPL (SEQ ID NO: 6455) |
| 373_A03 | SDYSMN (SEQ ID NO: 5561) | WVANINYNGGYTG (SEQ ID NO: 5740) | ARGANWHDTALD (SEQ ID NO: 5919) | LSYLNWY (SEQ ID NO: 6098) | LVIYAATSRA (SEQ ID NO: 6277) | QQSYDNPL (SEQ ID NO: 6456) |
| 373_A05 | SDYSMN (SEQ ID NO: 5562) | WVSGINYNSGYKS (SEQ ID NO: 5741) | ARGANWHDTHLD (SEQ ID NO: 5920) | LSYVNWY (SEQ ID NO: 6099) | LVIYAATSRH (SEQ ID NO: 6278) | QQSYESPL (SEQ ID NO: 6457) |
| 373_A09 | DSYSMN (SEQ ID NO: 5563) | WVAGINYNGGYTS (SEQ ID NO: 5742) | ARGANWHDTALD (SEQ ID NO: 5921) | LTYLNWY (SEQ ID NO: 6100) | LLIYAATSLA (SEQ ID NO: 6279) | QQSYDTPL (SEQ ID NO: 6458) |
| 373_A11 | SNYGMN (SEQ ID NO: 5564) | WVANINYNGGYTG (SEQ ID NO: 5743) | ARGANWHDTALD (SEQ ID NO: 5922) | LTYLNWY (SEQ ID NO: 6101) | LLIYAATSRA (SEQ ID NO: 6280) | QQSYDLPL (SEQ ID NO: 6459) |
| 373_A12 | SSYSMN (SEQ ID NO: 5565) | WVSSINYNGGYTS (SEQ ID NO: 5744) | ARGANWHDTALD (SEQ ID NO: 5923) | LTYLNWY (SEQ ID NO: 6102) | LVIYAATSRA (SEQ ID NO: 6281) | QQSYDTPL (SEQ ID NO: 6460) |
| 373_B05 | SDYSMN (SEQ ID NO: 5566) | WVSNINYNGGYKS (SEQ ID NO: 5745) | ARGANWHDTALD (SEQ ID NO: 5924) | VTYLNWY (SEQ ID NO: 6103) | LVIYAATSRA (SEQ ID NO: 6282) | QQSYSNPL (SEQ ID NO: 6461) |
| 373_B07 | DSYSMN (SEQ ID NO: 5567) | WVSGINYNGGYTS (SEQ ID NO: 5746) | ARGANWHDTALD (SEQ ID NO: 5925) | LTYVNWY (SEQ ID NO: 6104) | LVIYAATSRA (SEQ ID NO: 6283) | QQSYELPL (SEQ ID NO: 6462) |
| 373_C03 | SSYSMN (SEQ ID NO: 5568) | WVSGINYNGGYKS (SEQ ID NO: 5747) | ARGANWHDTALD (SEQ ID NO: 5926) | VTYLNWY (SEQ ID NO: 6105) | LVIYAATSRA (SEQ ID NO: 6284) | QQSYDSPL (SEQ ID NO: 6463) |
| 373_C07 | DSYSMN (SEQ ID NO: 5569) | WVAGINYNSGYTS (SEQ ID NO: 5748) | ARGANWHDTHLD (SEQ ID NO: 5927) | LTYLNWY (SEQ ID NO: 6106) | LVIYAATSRA (SEQ ID NO: 6285) | QQSYETPL (SEQ ID NO: 6464) |
| 373_C10 | SSYSMN (SEQ ID NO: 5570) | WVAGINYNGGYTS (SEQ ID NO: 5749) | ARGANWHDTALD (SEQ ID NO: 5928) | LTYVNWY (SEQ ID NO: 6107) | LLIYAATSRA (SEQ ID NO: 6286) | QQSYDNPL (SEQ ID NO: 6465) |
| 373_D03 | SSYSMN (SEQ ID NO: 5571) | WVSGINYNGGYTS (SEQ ID NO: 5750) | ARGANWHDTALD (SEQ ID NO: 5929) | VSYLNWY (SEQ ID NO: 6108) | LLIYAATSLA (SEQ ID NO: 6287) | QQSYDTPL (SEQ ID NO: 6466) |
| 373_D12 | DSYSMN (SEQ ID NO: 5572) | WVSSINYNSGYKG (SEQ ID NO: 5751) | ARGANWHDTHLD (SEQ ID NO: 5930) | LSYVNWY (SEQ ID NO: 6109) | LLIYAATSRA (SEQ ID NO: 6288) | QQSYSLPL (SEQ ID NO: 6467) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 373_E10 | SDYSMN (SEQ ID NO: 5573) | WVSGINYNGGYTS (SEQ ID NO: 5752) | ARGANWHDTALD (SEQ ID NO: 5931) | LTYVNWY (SEQ ID NO: 6110) | LVIYAATSRH (SEQ ID NO: 6289) | QQSYETPL (SEQ ID NO: 6468) |
| 373_F08 | SSYSMN (SEQ ID NO: 5574) | WVSGINYNGGYTS (SEQ ID NO: 5753) | ARGANWHDTALD (SEQ ID NO: 5932) | LTYLNWY (SEQ ID NO: 6111) | LLIYAATSRA (SEQ ID NO: 6290) | QQSYDTPL (SEQ ID NO: 6469) |
| 373_F11 | DSYGMH (SEQ ID NO: 5575) | WVSGINYNSGYTS (SEQ ID NO: 5754) | ARGANWHDTHLD (SEQ ID NO: 5933) | VSYVNWY (SEQ ID NO: 6112) | LLIYAATSRA (SEQ ID NO: 6291) | QQSYNLPL (SEQ ID NO: 6470) |
| 373_F12 | SSYSMN (SEQ ID NO: 5576) | WVSNINYNGGYTG (SEQ ID NO: 5755) | ARGANWHDTALD (SEQ ID NO: 5934) | STYLNWY (SEQ ID NO: 6113) | LVIYAATSRA (SEQ ID NO: 6292) | QQSYETPL (SEQ ID NO: 6471) |
| 373_G08 | DSYSMN (SEQ ID NO: 5577) | WVSNINYNGGYTS (SEQ ID NO: 5935) | ARGANWHDTALD (SEQ ID NO: 6114) | LTYLNWY (SEQ ID NO: 5756) | LLIYAATSLA (SEQ ID NO: 6293) | QQSYDSPL (SEQ ID NO: 6472) |
| 373_H03 | SSYSMN (SEQ ID NO: 5578) | WVSGINYNSGYKS (SEQ ID NO: 5757) | ARGANWHDTALD (SEQ ID NO: 5936) | LSYLNWY (SEQ ID NO: 6115) | LLIYATTSRA (SEQ ID NO: 6294) | QQSYENPL (SEQ ID NO: 6473) |
| 373_H07 | SSYSMN (SEQ ID NO: 5579) | WVAGINYNGGYTS (SEQ ID NO: 5758) | ARGANWHDTHLD (SEQ ID NO: 5937) | VTYLNWY (SEQ ID NO: 6116) | LLIYAASSLQ (SEQ ID NO: 6295) | QQSYDSPL (SEQ ID NO: 6474) |
| 373_H09 | SSYGMN (SEQ ID NO: 5580) | WVASINYNSGYKS (SEQ ID NO: 5759) | ARGANWHDTHLD (SEQ ID NO: 5938) | ITYLNWY (SEQ ID NO: 6117) | LVIYAATSRA (SEQ ID NO: 6296) | QQSDDSPL (SEQ ID NO: 6475) |
| 374_A06 | SSYSMN (SEQ ID NO: 5581) | WVSSINYNSGYTS (SEQ ID NO: 5760) | ARGANWHDTHLD (SEQ ID NO: 5939) | LSYLNWY (SEQ ID NO: 6118) | LVIYAATSRA (SEQ ID NO: 6297) | QQSYDSPL (SEQ ID NO: 6476) |
| 374_A09 | SSYSMN (SEQ ID NO: 5582) | WVSSINYNGGYKG (SEQ ID NO: 5761) | ARGANWHDTHLD (SEQ ID NO: 5940) | LTYVNWY (SEQ ID NO: 6119) | LLIYAATSLA (SEQ ID NO: 6298) | QQSYDSPL (SEQ ID NO: 6477) |
| 374_B03 | DSYSMN (SEQ ID NO: 5583) | WVSGINYNGGYTS (SEQ ID NO: 5762) | ARGANWHDTALD (SEQ ID NO: 5941) | LTYLNWY (SEQ ID NO: 6120) | LVIYAATSRA (SEQ ID NO: 6299) | QQSYDSPL (SEQ ID NO: 6478) |
| 374_B05 | DSYSMN (SEQ ID NO: 5584) | WVSGINYNSGYTS (SEQ ID NO: 5763) | ARGANWHDTALD (SEQ ID NO: 5942) | VSYLNWY (SEQ ID NO: 6121) | LLIYAATSRH (SEQ ID NO: 6300) | QQSYESPL (SEQ ID NO: 6479) |
| 374_B08 | DSYSMN (SEQ ID NO: 5585) | WVAGINYNGGYTS (SEQ ID NO: 5764) | ARGANWHDTALD (SEQ ID NO: 5943) | VSYVNWY (SEQ ID NO: 6122) | LLIYAATSRH (SEQ ID NO: 6301) | QQSYELPL (SEQ ID NO: 6480) |
| 374_B10 | SSYSMN (SEQ ID NO: 5586) | WVSSINYNSGYTS (SEQ ID NO: 5765) | ARGANWHDTHLD (SEQ ID NO: 5944) | LTYVNWY (SEQ ID NO: 6123) | LVIYAATSLA (SEQ ID NO: 6302) | QQSYDTPL (SEQ ID NO: 6481) |
| 374_C01 | DSYGMN (SEQ ID NO: 5587) | WVSGINYNSGYKS (SEQ ID NO: 5766) | ARGANWHDTALD (SEQ ID NO: 5945) | LTYLNWY (SEQ ID NO: 6124) | LLIYAATSRA (SEQ ID NO: 6303) | QQSYETPL (SEQ ID NO: 6482) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 374_C09 | DSYGMN (SEQ ID NO: 5588) | WVSSINYNGGYKG (SEQ ID NO: 5767) | ARGANWHDTHLD (SEQ ID NO: 5946) | VSYLNWY (SEQ ID NO: 6125) | LVIYAATSRA (SEQ ID NO: 6304) | QQSYELPL (SEQ ID NO: 6483) |
| 374_C12 | SSYSMN (SEQ ID NO: 5589) | WVAGINYNGGYKS (SEQ ID NO: 5768) | ARGANWHDTALD (SEQ ID NO: 5947) | LTYLNWY (SEQ ID NO: 6126) | LVIYAATSRA (SEQ ID NO: 6305) | QQSDNSPL (SEQ ID NO: 6484) |
| 374_D03 | DSYSMN (SEQ ID NO: 5590) | WVAGINYNGGYKS (SEQ ID NO: 5769) | ARGANWHDTHLD (SEQ ID NO: 5948) | VTYLNWY (SEQ ID NO: 6127) | LLIYAATSRA (SEQ ID NO: 6306) | QQSYDTPL (SEQ ID NO: 6485) |
| 374_D05 | DSYSMN (SEQ ID NO: 5591) | WVSGINYNSGYTG (SEQ ID NO: 5770) | ARGANWHDTHLD (SEQ ID NO: 5949) | LTYLNWY (SEQ ID NO: 6128) | LLIYAATSRA (SEQ ID NO: 6307) | QQSYDTPL (SEQ ID NO: 6486) |
| 374_D06 | SSYSMN (SEQ ID NO: 5592) | WVSGINYNGGYTS (SEQ ID NO: 5771) | ARGANWHDTALD (SEQ ID NO: 5950) | LSYVNWY (SEQ ID NO: 6129) | LVIYAATSRA (SEQ ID NO: 6308) | QQSYDSPL (SEQ ID NO: 6487) |
| 374_D07 | DSYSMN (SEQ ID NO: 5593) | WVSGINYNSGYKS (SEQ ID NO: 5772) | ARGANWHDTALD (SEQ ID NO: 5951) | VSYLNWY (SEQ ID NO: 6130) | LVIYAATSLA (SEQ ID NO: 6309) | QQSYNSPL (SEQ ID NO: 6488) |
| 374_D10 | SSYGMH (SEQ ID NO: 5594) | WVASINYNGGYTS (SEQ ID NO: 5773) | ARGANWHDTHLD (SEQ ID NO: 5952) | LTYVNWY (SEQ ID NO: 6131) | LLIYAATSRA (SEQ ID NO: 6310) | QQSYDNPL (SEQ ID NO: 6489) |
| 374_E10 | SSYSMN (SEQ ID NO: 5595) | WVSGINYNGGYKS (SEQ ID NO: 5774) | ARGANWHDTALD (SEQ ID NO: 5953) | LSYLNWY (SEQ ID NO: 6132) | LLIYAATSRH (SEQ ID NO: 6311) | QQSYDSPL (SEQ ID NO: 6490) |
| 374_E12 | SSYSMN (SEQ ID NO: 5596) | WVSGINYNGGYKS (SEQ ID NO: 5775) | ARGANWHDTALD (SEQ ID NO: 5954) | LSYLNWY (SEQ ID NO: 6133) | LVIYAATSRA (SEQ ID NO: 6312) | QQSYDNPL (SEQ ID NO: 6491) |
| 374_F06 | SSYSMN (SEQ ID NO: 5597) | WVSGINYNGGYTS (SEQ ID NO: 5776) | ARGANWHDTALD (SEQ ID NO: 5955) | ISYVNWY (SEQ ID NO: 6134) | LVIYAATSLH (SEQ ID NO: 6313) | QQSYSTPL (SEQ ID NO: 6492) |
| 374_F07 | DSYSMN (SEQ ID NO: 5598) | WVASINYNGGYTG (SEQ ID NO: 5777) | ARGANWHDTHLD (SEQ ID NO: 5956) | LSYLNWY (SEQ ID NO: 6135) | LVIYAVTSLA (SEQ ID NO: 6314) | QQSYESPL (SEQ ID NO: 6493) |
| 374_F08 | DSYSMN (SEQ ID NO: 5599) | WVSGINYNGGYKS (SEQ ID NO: 5778) | ARGANWHDTALD (SEQ ID NO: 5957) | LTYVNWY (SEQ ID NO: 6136) | LVIYAVTSRA (SEQ ID NO: 6315) | QQSYDTPL (SEQ ID NO: 6494) |
| 374_G03 | SDYSMN (SEQ ID NO: 5600) | WVSGINYNGGYTS (SEQ ID NO: 5779) | ARGANWHDTALD (SEQ ID NO: 5958) | SSYLNWY (SEQ ID NO: 6137) | LVIYAATSRA (SEQ ID NO: 6316) | QQSDDTPL (SEQ ID NO: 6495) |
| 374_G08 | DSYSMN (SEQ ID NO: 5601) | WVSGINYNGGYTS (SEQ ID NO: 5780) | ARGANWHDTALD (SEQ ID NO: 5959) | LTYVNWY (SEQ ID NO: 6138) | LVIYAATSRA (SEQ ID NO: 6317) | QQSYDSPL (SEQ ID NO: 6496) |
| 374_G09 | SSYSMN (SEQ ID NO: 5602) | WVAGINYNGGYKG (SEQ ID NO: 5781) | ARGANWHDTHLD (SEQ ID NO: 5960) | VRYLNWY (SEQ ID NO: 6139) | LVIYAATSLA (SEQ ID NO: 6318) | QQSYELPL (SEQ ID NO: 6497) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 374_G10 | SSYSMN (SEQ ID NO: 5603) | WVSSINYNSGYTS (SEQ ID NO: 5782) | ARGANWHDTHLD (SEQ ID NO: 5961) | VSYLNWY (SEQ ID NO: 6140) | LVIYAVTSRA (SEQ ID NO: 6319) | QQSYDSPL (SEQ ID NO: 6498) |
| 374_G11 | SDYSMN (SEQ ID NO: 5604) | WVSGINYNGGYTS (SEQ ID NO: 5783) | ARGANWHDTALD (SEQ ID NO: 5962) | ISYVNWY (SEQ ID NO: 6141) | LVIYAATSLA (SEQ ID NO: 6320) | QQSYDSPL (SEQ ID NO: 6499) |
| 374_H01 | DSYSMN (SEQ ID NO: 5605) | WVAGINYNGGYTS (SEQ ID NO: 5784) | ARGANWHDTHLD (SEQ ID NO: 5963) | LSYLNWY (SEQ ID NO: 6142) | LVIYAATSLA (SEQ ID NO: 6321) | QQSYENPL (SEQ ID NO: 6500) |
| 374_H11 | SSYSMN (SEQ ID NO: 5606) | WVSGINYNGGYTS (SEQ ID NO: 5785) | ARGANWHDTALD (SEQ ID NO: 5964) | ISYVNWY (SEQ ID NO: 6143) | LVIYAATSLH (SEQ ID NO: 6322) | QQSYSNPL (SEQ ID NO: 6501) |
| 375_A01 | DSYSMN (SEQ ID NO: 5607) | WVAGINYNGGYTS (SEQ ID NO: 5786) | ARGANWHDTALD (SEQ ID NO: 5965) | LSYLNWY (SEQ ID NO: 6144) | LVIYAATSRA (SEQ ID NO: 6323) | QQSYNTPL (SEQ ID NO: 6502) |
| 375_A07 | DSYSMN (SEQ ID NO: 5608) | WVSSINYNSGYTG (SEQ ID NO: 5787) | ARGANWHDTHLD (SEQ ID NO: 5966) | LTYLNWY (SEQ ID NO: 6145) | LLIYAATSRA (SEQ ID NO: 6324) | QQSYDTPL (SEQ ID NO: 6503) |
| 375_A08 | SSYSMN (SEQ ID NO: 5609) | WVAGINYNGGYTG (SEQ ID NO: 5788) | ARGANWHDTALD (SEQ ID NO: 5967) | VTYLNWY (SEQ ID NO: 6146) | LLIYAATSRA (SEQ ID NO: 6325) | QQSYESPL (SEQ ID NO: 6504) |
| 375_A12 | SSYSMN (SEQ ID NO: 5610) | WVSGINYNSGYKS (SEQ ID NO: 5789) | ARGANWHDTALD (SEQ ID NO: 5968) | LSYLNWY (SEQ ID NO: 6147) | LVIYAVTSRA (SEQ ID NO: 6326) | QQSYETPL (SEQ ID NO: 6505) |
| 375_B12 | DSYSMN (SEQ ID NO: 5611) | WVAGINYNGGYKS (SEQ ID NO: 5790) | ARGANWHDTALD (SEQ ID NO: 5969) | VTYLNWY (SEQ ID NO: 6148) | LLIYAATSRA (SEQ ID NO: 6327) | QQSYDTPL (SEQ ID NO: 6506) |
| 375_C04 | SDYSMN (SEQ ID NO: 5612) | WVAGINYNGGYTS (SEQ ID NO: 5791) | ARGANWHDTALD (SEQ ID NO: 5970) | LTYLNWY (SEQ ID NO: 6149) | LVIYAATSRA (SEQ ID NO: 6328) | QQSYESPL (SEQ ID NO: 6507) |
| 375_D01 | SSYSMN (SEQ ID NO: 5613) | WVSGINYNGGYTG (SEQ ID NO: 5792) | ARGANWHDTALD (SEQ ID NO: 5971) | LTYLNWY (SEQ ID NO: 6150) | LVIYAATSRA (SEQ ID NO: 6329) | QQSYETPL (SEQ ID NO: 6508) |
| 375_D10 | SSYSMN (SEQ ID NO: 5614) | WVAGINYNGGYTS (SEQ ID NO: 5793) | ARGANWHDTALD (SEQ ID NO: 5972) | LTYVNWY (SEQ ID NO: 6151) | LLIYAATSRA (SEQ ID NO: 6330) | QQSDDSPL (SEQ ID NO: 6509) |
| 375_E02 | SDYSMN (SEQ ID NO: 5615) | WVAGINYNGGYTS (SEQ ID NO: 5794) | ARGANWHDTALD (SEQ ID NO: 5973) | LTYLNWY (SEQ ID NO: 6152) | LLIYAATSRA (SEQ ID NO: 6331) | QQSYSSPL (SEQ ID NO: 6510) |
| 375_E03 | SDYSMN (SEQ ID NO: 5616) | WVANINYNGGYTG (SEQ ID NO: 5795) | ARGANWHDTHLD (SEQ ID NO: 5974) | LTYLNWY (SEQ ID NO: 6153) | LVIYAATSLA (SEQ ID NO: 6332) | QQSYDNPL (SEQ ID NO: 6511) |
| 375_E05 | SSYSMN (SEQ ID NO: 5617) | WVAGINYNGGYTS (SEQ ID NO: 5796) | ARGANWHDTALD (SEQ ID NO: 5975) | LSYLNWY (SEQ ID NO: 6154) | LVIYAATSLA (SEQ ID NO: 6333) | QQSYSSPL (SEQ ID NO: 6512) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 375_E06 | SSYSMN (SEQ ID NO: 5618) | WVSGINYNGGYKS (SEQ ID NO: 5797) | ARGANWHDTALD (SEQ ID NO: 5976) | LSYLNWY (SEQ ID NO: 6155) | LVIYAATSRA (SEQ ID NO: 6334) | QQSYDSPL (SEQ ID NO: 6513) |
| 375_E10 | SSYSMN (SEQ ID NO: 5619) | WVSGINYNGGYTS (SEQ ID NO: 5798) | ARGANWHDTALD (SEQ ID NO: 5977) | LSYLNWY (SEQ ID NO: 6156) | LVIYAATSRA (SEQ ID NO: 6335) | QQSYDNPL (SEQ ID NO: 6514) |
| 375_F02 | SSYSMN (SEQ ID NO: 5620) | WVASINYNSGYTS (SEQ ID NO: 5799) | ARGANWHDTHLD (SEQ ID NO: 5978) | LSYLNWY (SEQ ID NO: 6157) | LLIYAATSRA (SEQ ID NO: 6336) | QQSYDSPL (SEQ ID NO: 6515) |
| 375_F07 | SDYSMN (SEQ ID NO: 5621) | WVSNINYNGGYTG (SEQ ID NO: 5800) | ARGANWHDTALD (SEQ ID NO: 5979) | LSYLNWY (SEQ ID NO: 6158) | LLIYAATSRA (SEQ ID NO: 6337) | QQSYDSPL (SEQ ID NO: 6516) |
| 375_F08 | SSYGMN (SEQ ID NO: 5622) | WVSSINYNSGYKS (SEQ ID NO: 5801) | ARGANWHDTHLD (SEQ ID NO: 5980) | LSYLNWY (SEQ ID NO: 6159) | LLIYAATSRH (SEQ ID NO: 6338) | QQSYDNPL (SEQ ID NO: 6517) |
| 375_G04 | SSYGMN (SEQ ID NO: 5623) | WVASINYNSGYTG (SEQ ID NO: 5802) | ARGANWHDTHLD (SEQ ID NO: 5981) | VSYVNWY (SEQ ID NO: 6160) | LLIYAATSLA (SEQ ID NO: 6339) | QQSYDSPL (SEQ ID NO: 6518) |
| 375_G05 | SSYSMN (SEQ ID NO: 5624) | WVAGINYNGGYTS (SEQ ID NO: 5803) | ARGANWHDTALD (SEQ ID NO: 5982) | VSYLNWY (SEQ ID NO: 6161) | LLIYAVTSRA (SEQ ID NO: 6340) | QQSYDSPL (SEQ ID NO: 6519) |
| 375_H05 | SSYSMN (SEQ ID NO: 5625) | WVSNINYNGGYTG (SEQ ID NO: 5804) | ARGANWHDTALD (SEQ ID NO: 5983) | LSYVNWY (SEQ ID NO: 6162) | LLIYAATSRA (SEQ ID NO: 6341) | QQSYDTPL (SEQ ID NO: 6520) |
| 375_H07 | SSYSMN (SEQ ID NO: 5626) | WVAGINYNGGYTS (SEQ ID NO: 5805) | ARGANWHDTALD (SEQ ID NO: 5984) | LSYLNWY (SEQ ID NO: 6163) | LLIYAATSLA (SEQ ID NO: 6342) | QQSYSSPL (SEQ ID NO: 6521) |
| 376_A03 | SSYGMN (SEQ ID NO: 5627) | WVAGINYNGGYTG (SEQ ID NO: 5806) | ARGANWHDTALD (SEQ ID NO: 5985) | LTYLNWY (SEQ ID NO: 6164) | LLIYAATSRA (SEQ ID NO: 6343) | QQSYSTPL (SEQ ID NO: 6522) |
| 376_B03 | SSYSMN (SEQ ID NO: 5628) | WVAGINYNSGYKS (SEQ ID NO: 5807) | ARGANWHDTALD (SEQ ID NO: 5986) | LSYVNWY (SEQ ID NO: 6165) | LVIYAVTSRH (SEQ ID NO: 6344) | QQSYDSPL (SEQ ID NO: 6523) |
| 376_B10 | SDYSMN (SEQ ID NO: 5629) | WVAGINYNGGYKG (SEQ ID NO: 5808) | ARGANWHDTALD (SEQ ID NO: 5987) | LSYLNWY (SEQ ID NO: 6166) | LVIYAATSLA (SEQ ID NO: 6345) | QQSYSTPL (SEQ ID NO: 6524) |
| 376_C04 | SSYGMN (SEQ ID NO: 5630) | WVSNINYNGGYTG (SEQ ID NO: 5809) | ARGANWHDTALD (SEQ ID NO: 5988) | LSYVNWY (SEQ ID NO: 6167) | LLIYAVTSRH (SEQ ID NO: 6346) | QQSYDNPL (SEQ ID NO: 6525) |
| 376_C08 | DSYSMN (SEQ ID NO: 5631) | WVAGINYNSGYTG (SEQ ID NO: 5810) | ARGANWHDTHLD (SEQ ID NO: 5989) | LSYLNWY (SEQ ID NO: 6168) | LLIYAASSLQ (SEQ ID NO: 6347) | QQSYSTPL (SEQ ID NO: 6526) |

TABLE 3C-continued

CDR sequences for Group III antibodies

| Ab | HCDR1 | HCDR2 | HCDR3 | LCDR1 | LCDR2 | LCDR3 |
|---|---|---|---|---|---|---|
| 376_D07 | DSYSMN (SEQ ID NO: 5632) | WVSGINYNGGYTS (SEQ ID NO: 5811) | ARGANWHDTHLD (SEQ ID NO: 5990) | SSYLNWY (SEQ ID NO: 6169) | LLIYAASSLQ (SEQ ID NO: 6348) | QQSYSTPL (SEQ ID NO: 6527) |
| 376_E02 | SSYSMN (SEQ ID NO: 5633) | WVAGINYNGGYKG (SEQ ID NO: 5812) | ARGANWHDTALD (SEQ ID NO: 5991) | LSYVNWY (SEQ ID NO: 6170) | LVIYAATSRH (SEQ ID NO: 6349) | QQSDNTPL (SEQ ID NO: 6528) |
| 376_E11 | SSYSMN (SEQ ID NO: 5634) | WVSGINYNGGYTS (SEQ ID NO: 5813) | ARGANWHDTALD (SEQ ID NO: 5992) | LTYVNWY (SEQ ID NO: 6171) | LVIYAATSRA (SEQ ID NO: 6350) | QQSYELPL (SEQ ID NO: 6529) |
| 376_F01 | SDYSMN (SEQ ID NO: 5635) | WVAGINYNGGYKS (SEQ ID NO: 5814) | ARGANWHDTALD (SEQ ID NO: 5993) | SSYLNWY (SEQ ID NO: 6172) | LLIYAASSLQ (SEQ ID NO: 6351) | QQSYSTPL (SEQ ID NO: 6530) |
| 376_F06 | SSYGMN (SEQ ID NO: 5636) | WVSGINYNGGYTG (SEQ ID NO: 5815) | ARGANWHDTHLD (SEQ ID NO: 5994) | LTYVNWY (SEQ ID NO: 6173) | LVIYAATSRA (SEQ ID NO: 6352) | QQSYETPL (SEQ ID NO: 6531) |
| 376_G05 | SSYSMN (SEQ ID NO: 5637) | WVAGINYNGGYTS (SEQ ID NO: 5816) | ARGANWHDTALD (SEQ ID NO: 5995) | ISYVNWY (SEQ ID NO: 6174) | LVIYAATSRA (SEQ ID NO: 6353) | QQSYESPL (SEQ ID NO: 6532) |
| 376_G06 | SSYGMN (SEQ ID NO: 5638) | WVAGINYNGGYTG (SEQ ID NO: 5817) | ARGANWHDTHLD (SEQ ID NO: 5996) | VSYVNWY (SEQ ID NO: 6175) | LVIYAATSRA (SEQ ID NO: 6354) | QQSYNSPL (SEQ ID NO: 6533) |
| 376_G10 | DSYGMN (SEQ ID NO: 5639) | WVAGINYNGGYTS (SEQ ID NO: 5818) | ARGANWHDTALD (SEQ ID NO: 5997) | LSYVNWY (SEQ ID NO: 6176) | LLIYAATSRA (SEQ ID NO: 6355) | QQSYESPL (SEQ ID NO: 6534) |
| 376_H01 | SDYSMN (SEQ ID NO: 5640) | WVAGINYNGGYKG (SEQ ID NO: 5819) | ARGANWHDTALD (SEQ ID NO: 5998) | LTYLNWY (SEQ ID NO: 6177) | LLIYAATSRA (SEQ ID NO: 6356) | QQSYSTPL (SEQ ID NO: 6535) |
| 376_H04 | SSYSMN (SEQ ID NO: 5641) | WVAGINYNGGYKG (SEQ ID NO: 5820) | ARGANWHDTALD (SEQ ID NO: 5999) | LTYVNWY (SEQ ID NO: 6178) | LVIYAATSRA (SEQ ID NO: 6357) | QQSYDLPL (SEQ ID NO: 6536) |
| 376_H11 | DSYSMN (SEQ ID NO: 5642) | WVSNINYNGGYTG (SEQ ID NO: 5821) | ARGANWHDTALD (SEQ ID NO: 6000) | SRYLNWY (SEQ ID NO: 6179) | LLIYAVTSLA (SEQ ID NO: 6358) | QQSYESPL (SEQ ID NO: 6537) |

The consensus sequences for each of these CDRs shown in FIG. 3C are as follows:

HCDR1:
(SEQ ID NO: 6566)
S/DS/DYS/GMN/H

HCDR2:
(SEQ ID NO: 6594)
WVS/AG/S/NINYNG/SGYT/KS/G

HCDR3:
(SEQ ID NO: 6543)
ARGANWHDTA/HLD

LCDR1:
(SEQ ID NO: 6569)
L/V/S/IS/TYL/VNWY

LCDR2:
(SEQ ID NO:)
LL/VIYAA/V/TT/SSR/LA/H/Q

LCDR3:
(SEQ ID NO: 6571)
QQSY/DD/E/S/NS/T/N/LPL

TABLE 2D

| | Group IV Antibody Sequences | |
|---|---|---|
| Ab | VH sequence | VL sequence |

365_A08  EVQLLESGGGLVQPGGSLRLSCAASGFTF  DIQMTQSPSSLSASVGDRVTITCRASQSIITYLN
        SSYSMNWVRQAPGKGLEWVASINYNGGYK  WYQQKPGKAPKLVIYAATSRASGVPSRFSGSGSG
        SYADSVKGRFTISRDNSKNTLYLQMNSLR  TDFTLTISSLQPEDFATYYCQQSDNTPLTFGGGT
        AEDTAVYYCARGATWHDTHLDYWGQGTLV  KVEIK (SEQ ID NO: 1477)
        TVSS (SEQ ID NO: 1384)

365_A09  EVQLLESGGGLVQPGGSLRLSCAASGFTF  DIQMTQSPSSLSASVGDRVTITCRASQSILSYVN
        SSYGMHWVRQAPGKGLEWVASINYNGGYT  WYQQKPGKAPKLLIYAATSRASGVPSRFSGSGSG
        SYADSVKGRFTISRDNSKNTLYLQMNSLR  TDFTLTISSLQPEDFATYYCQQSYDLPLTFGGGT
        AEDTAVYYCARGATWHDTHLDYWGQGTLV  KVEIK (SEQ ID NO: 1478)
        TVSS (SEQ ID NO: 1385)

365_C02  EVQLLESGGGLVQPGGSLRLSCAASGFTF  DIQMTQSPSSLSASVGDRVTITCRASQSISTYLN
        DSYSMNWVRQAPGKGLEWVSNINYNGGYK  WYQQKPGKAPKLVIYAATSRHSGVPSRFSGSGSG
        GYADSVKGRFTISRDNSKNTLYLQMNSLR  TDFTLTISSLQPEDFATYYCQQSYENPLTFGGGT
        AEDTAVYYCARGATWHDTHLDYWGQGTLV  KVEIK (SEQ ID NO: 1479)
        TVSS (SEQ ID NO: 1386)

365_C04  EVQLLESGGGLVQPGGSLRLSCAASGFTF  DIQMTQSPSSLSASVGDRVTITCRASQSILTYLN
        DSYSMNWVRQAPGKGLEWVANINYNGGYK  WYQQKPGKAPKLVIYAATSLASGVPSRFSGSGSG
        GYADSVKGRFTISRDNSKNTLYLQMNSLR  TDFTLTISSLQPEDFATYYCQQSYDTPLTFGGGT
        AEDTAVYYCARGATWHDTHLDYWGQGTLV  KVEIK (SEQ ID NO: 1480)
        TVSS (SEQ ID NO: 1387)

365_D02  EVQLLESGGGLVQPGGSLRLSCAASGFTF  DIQMTQSPSSLSASVGDRVTITCRASQSIVTYLN
        SSYSMHWVRQAPGKGLEWVASINYNGGYT  WYQQKPGKAPKLLIYAATSLASGVPSRFSGSGSG
        SYADSVKGRFTISRDNSKNTLYLQMNSLR  TDFTLTISSLQPEDFATYYCQQSYDNPLTFGGGT
        AEDTAVYYCARGATWHDTHLDYWGQGTLV  KVEIK (SEQ ID NO: 1481)
        TVSS (SEQ ID NO: 1388)

365_D07  EVQLLESGGGLVQPGGSLRLSCAASGFTF  DIQMTQSPSSLSASVGDRVTITCRASQSISSYLN
        SSYGMNWVRQAPGKGLEWVSSINYNSGYK  WYQQKPGKAPKLLIYAASSLQSGVPSRFSGSGSG
        SYADSVKGRFTISRDNSKNTLYLQMNSLR  TDFTLTISSLQPEDFATYYCQQSYSTPLTFGGGT
        AEDTAVYYCARGATWHDTHLDYWGQGTLV  KVEIK (SEQ ID NO: 1482)
        TVSS (SEQ ID NO: 1389)

365_D10  EVQLLESGGGLVQPGGSLRLSCAASGFTF  DIQMTQSPSSLSASVGDRVTITCRASQSISTYLN
        SSYSMNWVRQAPGKGLEWVAGINYNGGYT  WYQQKPGKAPKLLIYAATSRASGVPSRFSGSGSG
        GYADSVKGRFTISRDNSKNTLYLQMNSLR  TDFTLTISSLQPEDFATYYCQQSYESPLTFGGGT
        AEDTAVYYCARGATWHDTHLDYWGQGTLV  KVEIK (SEQ ID NO: 1483)
        TVSS (SEQ ID NO: 1390)

365_E11  EVQLLESGGGLVQPGGSLRLSCAASGFTF  DIQMTQSPSSLSASVGDRVTITCRASQSISSYLN
        DDYSMNWVRQAPGKGLEWVSSINYNGGYK  WYQQKPGKAPKLLIYAASSLQSGVPSRFSGSGSG
        SYADSVKGRFTISRDNSKNTLYLQMNSLR  TDFTLTISSLQPEDFATYYCQQSYNTPLTFGGGT
        AEDTAVYYCARGATWHDTHLDYWGQGTLV  KVEIK (SEQ ID NO: 1484)
        TVSS (SEQ ID NO: 1391)

365_F05  EVQLLESGGGLVQPGGSLRLSCAASGFTF  DIQMTQSPSSLSASVGDRVTITCRASQSIVTYVN
        SSYGMNWVRQAPGKGLEWVASINYNGGYT  WYQQKPGKAPKLLIYAATSRASGVPSRFSGSGSG
        SYADSVKGRFTISRDNSKNTLYLQMNSLR  TDFTLTISSLQPEDFATYYCQQSYETPLTFGGGT
        AEDTAVYYCARGATWHDTHLDYWGQGTLV  KVEIK (SEQ ID NO: 1485)
        TVSS (SEQ ID NO: 1392)

365_H05  EVQLLESGGGLVQPGGSLRLSCAASGFTF  DIQMTQSPSSLSASVGDRVTITCRASQSILTYVN
        SSYGMNWVRQAPGKGLEWVAGINYNGGYT  WYQQKPGKAPKLLIYAATSLHSGVPSRFSGSGSG
        SYADSVKGRFTISRDNSKNTLYLQMNSLR  TDFTLTISSLQPEDFATYYCQQSYSTPLTFGGGT
        AEDTAVYYCARGATWHDTHLDYWGQGTLV  KVEIK (SEQ ID NO: 1486)
        TVSS (SEQ ID NO: 1393)

366_D08  EVQLLESGGGLVQPGGSLRLSCAASGFTF  DIQMTQSPSSLSASVGDRVTITCRASQSILSYVN
        SSYGMHWVRQAPGKGLEWVSNINYNGGYK  WYQQKPGKAPKLVIYAATSLASGVPSRFSGSGSG
        SYADSVKGRFTISRDNSKNTLYLQMNSLR  TDFTLTISSLQPEDFATYYCQQSYENPLTFGGGT
        AEDTAVYYCARGATWHDTHLDYWGQGTLV  KVEIK (SEQ ID NO: 1487)
        TVSS (SEQ ID NO: 1394)

366_F08  EVQLLESGGGLVQPGGSLRLSCAASGFTF  DIQMTQSPSSLSASVGDRVTITCRASQSISSYLN
        SSYGMNWVRQAPGKGLEWVSSINYNGGYT  WYQQKPGKAPKLLIYAASSLQSGVPSRFSGSGSG
        SYADSVKGRFTISRDNSKNTLYLQMNSLR  TDFTLTISSLQPEDFATYYCQQSYSTPLTFGGGT
        AEDTAVYYCARGATWHDTHLDYWGQGTLV  KVEIK (SEQ ID NO: 1488)
        TVSS (SEQ ID NO: 1395)

TABLE 2D-continued

Group IV Antibody Sequences

| Ab | VH sequence | VL sequence |
|---|---|---|
| 366_G09 | EVQLLESGGGLVQPGGSLRLSCAASGFTF DDYSMNWVRQAPGKGLEWVASINYNSGYT GYADSVKGRFTISRDNSKNTLYLQMNSLR AEDTAVYYCARGATWHDTHLDYWGQGTLV TVSS (SEQ ID NO: 1396) | DIQMTQSPSSLSASVGDRVTITCRASQSILSYVN WYQQKPGKAPKLVIYAATSRASGVPSRFSGSGSG TDFTLTISSLQPEDFATYYCQQSYDLPLTFGGGT KVEIK (SEQ ID NO: 1489) |
| 367_A02 | EVQLLESGGGLVQPGGSLRLSCAASGFTF DSYGMNWVRQAPGKGLEWVSSINYNSGYK GYADSVKGRFTISRDNSKNTLYLQMNSLR AEDTAVYYCARGATWHDTHLDYWGQGTLV TVSS (SEQ ID NO: 1397) | DIQMTQSPSSLSASVGDRVTITCRASQSIISYLN WYQQKPGKAPKLLIYAVTSRASGVPSRFSGSGSG TDFTLTISSLQPEDFATYYCQQSYDTPLTFGGGT KVEIK (SEQ ID NO: 1490) |
| 367_B06 | EVQLLESGGGLVQPGGSLRLSCAASGFTF SSYSMNWVRQAPGKGLEWVANINYNGGYT GYADSVKGRFTISRDNSKNTLYLQMNSLR AEDTAVYYCARGATWHDTHLDYWGQGTLV TVSS (SEQ ID NO: 1398) | DIQMTQSPSSLSASVGDRVTITCRASQSIISYVN WYQQKPGKAPKLVIYAATSLHSGVPSRFSGSGSG TDFTLTISSLQPEDFATYYCQQSYNSPLTFGGGT KVEIK (SEQ ID NO: 1491) |
| 367_C08 | EVQLLESGGGLVQPGGSLRLSCAASGFTF DSYSMHWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1399) | DIQMTQSPSSLSASVGDRVTITCRASQSILTYLN WYQQKPGKAPKLLIYAATSLASGVPSRFSGSGSG TDFTLTISSLQPEDFATYYCQQSDSNPLTFGGGT KVEIK (SEQ ID NO: 1492) |
| 367_D05 | EVQLLESGGGLVQPGGSLRLSCAASGFTF SDYSMNWVRQAPGKGLEWVSSINYNGGYK SYADSVKGRFTISRDNSKNTLYLQMNSLR AEDTAVYYCARGATWHDTHLDYWGQGTLV TVSS (SEQ ID NO: 1400) | DIQMTQSPSSLSASVGDRVTITCRASQSIISYVN WYQQKPGKAPKLVIYAATSLASGVPSRFSGSGSG TDFTLTISSLQPEDFATYYCQQSYDSPLTFGGGT KVEIK (SEQ ID NO: 1493) |
| 367_D09 | EVQLLESGGGLVQPGGSLRLSCAASGFTF DSYGMNWVRQAPGKGLEWVASINYNGGYK SYADSVKGRFTISRDNSKNTLYLQMNSLR AEDTAVYYCARGATWHDTHLDYWGQGTLV TVSS (SEQ ID NO: 1401) | DIQMTQSPSSLSASVGDRVTITCRASQSILTYLN WYQQKPGKAPKLLIYAATSLASGVPSRFSGSGSG TDFTLTISSLQPEDFATYYCQQSYDNPLTFGGGT KVEIK (SEQ ID NO: 1494) |
| 367_E07 | EVQLLESGGGLVQPGGSLRLSCAASGFTF SDYSMNWVRQAPGKGLEWVSSINYNGGYK GYADSVKGRFTISRDNSKNTLYLQMNSLR AEDTAVYYCARGATWHDTHLDYWGQGTLV TVSS (SEQ ID NO: 1402) | DIQMTQSPSSLSASVGDRVTITCRASQSILSYVN WYQQKPGKAPKLVIYAATSRASGVPSRFSGSGSG TDFTLTISSLQPEDFATYYCQQSYENPLTFGGGT KVEIK (SEQ ID NO: 1495) |
| 367_E12 | EVQLLESGGGLVQPGGSLRLSCAASGFTF SSYGMHWVRQAPGKGLEWVASINYNGGYT SYADSVKGRFTISRDNSKNTLYLQMNSLR AEDTAVYYCARGATWHDTHLDYWGQGTLV TVSS (SEQ ID NO: 1403) | DIQMTQSPSSLSASVGDRVTITCRASQSILTYVN WYQQKPGKAPKLLIYAASSLQSGVPSRFSGSGSG TDFTLTISSLQPEDFATYYCQQSYNSPLTFGGGT KVEIK (SEQ ID NO: 1496) |
| 367_F09 | EVQLLESGGGLVQPGGSLRLSCAASGFTF DSYSMHWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1404) | DIQMTQSPSSLSASVGDRVTITCRASQSILTYLN WYQQKPGKAPKLLIYAATSLASGVPSRFSGSGSG TDFTLTISSLQPEDFATYYCQQSDSNPLTFGGGT KVEIK (SEQ ID NO: 1497) |
| 367_H05 | EVQLLESGGGLVQPGGSLRLSCAASGFTF SSYGMHWVRQAPGKGLEWVASINYNSGYK SYADSVKGRFTISRDNSKNTLYLQMNSLR AEDTAVYYCARGATWHDTHLDYWGQGTLV TVSS (SEQ ID NO: 1405) | DIQMTQSPSSLSASVGDRVTITCRASQSILSYVN WYQQKPGKAPKLIYAASSLQSGVPSRFSGSGSG TDFTLTISSLQPEDFATYYCQQSYSTPLTFGGGT KVEIK (SEQ ID NO: 1498) |
| 367_H10 | EVQLLESGGGLVQPGGSLRLSCAASGFTF SSYGMNWVRQAPGKGLEWVASINYNGGYT GYADSVKGRFTISRDNSKNTLYLQMNSLR AEDTAVYYCARGATWHDTHLDYWGQGTLV TVSS (SEQ ID NO: 1406) | DIQMTQSPSSLSASVGDRVTITCRASQSILSYVN WYQQKPGKAPKLVIYAATSRASGVPSRFSGSGSG TDFTLTISSLQPEDFATYYCQQSYELPLTFGGGT KVEIK (SEQ ID NO: 1499) |
| 368_B02 | EVQLLESGGGLVQPGGSLRLSCAASGFTF SSYGMNWVRQAPGKGLEWVSGINYNSGYK SYADSVKGRFTISRDNSKNTLYLQMNSLR AEDTAVYYCARGATWHDTHLDYWGQGTLV TVSS (SEQ ID NO: 1407) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 1500) |

TABLE 2D-continued

Group IV Antibody Sequences

| Ab | VH sequence | VL sequence |
|---|---|---|
| 368_C11 | EVQLLESGGGLVQPGGSLRLSCAASGFTF SDYSMNWVRQAPGKGLEWVSSINYNSGYK SYADSVKGRFTISRDNSKNTLYLQMNSLR AEDTAVYYCARGATWHDTHLDYWGQGTLV TVSS (SEQ ID NO: 1408) | DIQMTQSPSSLSASVGDRVTITCRASQSIISYLN WYQQKPGKAPKLLIYAATSRASGVPSRFSGSGSG TDFTLTISSLQPEDFATYYCQQSYDNPLTFGGGT KVEIK (SEQ ID NO: 1501) |
| 368_D02 | EVQLLESGGGLVQPGGSLRLSCAASGFTF DDYGMNWVRQAPGKGLEWVSNINYNGGYT GYADSVKGRFTISRDNSKNTLYLQMNSLR AEDTAVYYCARGATWHDTHLDYWGQGTLV TVSS (SEQ ID NO: 1409) | DIQMTQSPSSLSASVGDRVTITCRASQSISTYLN WYQQKPGKAPKLVIYAATSRHSGVPSRFSGSGSG TDFTLTISSLQPEDFATYYCQQSYDTPLTFGGGT KVEIK (SEQ ID NO: 1502) |
| 368_D12 | EVQLLESGGGLVQPGGSLRLSCAASGFTF SSYGMNWVRQAPGKGLEWVSSINYNGGYT SYADSVKGRFTISRDNSKNTLYLQMNSLR AEDTAVYYCARGATWHDTHLDYWGQGTLV TVSS (SEQ ID NO: 1410) | DIQMTQSPSSLSASVGDRVTITCRASQSILSYVN WYQQKPGKAPKLVIYAATSRASGVPSRFSGSGSG TDFTLTISSLQPEDFATYYCQQSYNNPLTFGGGT KVEIK (SEQ ID NO: 1503) |
| 368_F06 | EVQLLESGGGLVQPGGSLRLSCAASGFTF DDYSMHWVRQAPGKGLEWVANINYNSGYT GYADSVKGRFTISRDNSKNTLYLQMNSLR AEDTAVYYCARGATWHDTHLDYWGQGTLV TVSS (SEQ ID NO: 1411) | DIQMTQSPSSLSASVGDRVTITCRASQSILSYLN WYQQKPGKAPKLVIYATTSRASGVPSRFSGSGSG TDFTLTISSLQPEDFATYYCQQSYENPLTFGGGT KVEIK (SEQ ID NO: 1504) |
| 368_G03 | EVQLLESGGGLVQPGGSLRLSCAASGFTF SSYSMNWVRQAPGKGLEWVSGINYNSGYT SYADSVKGRFTISRDNSKNTLYLQMNSLR AEDTAVYYCARGATWHDTALDYWGQGTLV TVSS (SEQ ID NO: 1412) | DIQMTQSPSSLSASVGDRVTITCRASQSILSYLN WYQQKPGKAPKLVIYAATSRASGVPSRFSGSGSG TDFTLTISSLQPEDFATYYCQQSYDTPLTFGGGT KVEIK (SEQ ID NO: 1505) |
| 368_G10 | EVQLLESGGGLVQPGGSLRLSCAASGFTF SSYSMHWVRQAPGKGLEWVSSINYNGGYT SYADSVKGRFTISRDNSKNTLYLQMNSLR AEDTAVYYCARGATWHDTHLDYWGQGTLV TVSS (SEQ ID NO: 1413) | DIQMTQSPSSLSASVGDRVTITCRASQSIVSYVN WYQQKPGKAPKLVIYAATSRASGVPSRFSGSGSG TDFTLTISSLQPEDFATYYCQQSYDTPLTFGGGT KVEIK (SEQ ID NO: 1506) |
| 368_H06 | EVQLLESGGGLVQPGGSLRLSCAASGFTF DSYGMHWVRQAPGKGLEWVANINYNGGYK SYADSVKGRFTISRDNSKNTLYLQMNSLR AEDTAVYYCARGATWHDTHLDYWGQGTLV TVSS (SEQ ID NO: 1414) | DIQMTQSPSSLSASVGDRVTITCRASQSILTYVN WYQQKPGKAPKLLIYATTSRASGVPSRFSGSGSG TDFTLTISSLQPEDFATYYCQQSYDNPLTFGGGT KVEIK (SEQ ID NO: 1507) |
| 368_H11 | EVQLLESGGGLVQPGGSLRLSCAASGFTF DSYGMHWVRQAPGKGLEWVASINYNGGYT SYADSVKGRFTISRDNSKNTLYLQMNSLR AEDTAVYYCARGATWHDTHLDYWGQGTLV TVSS (SEQ ID NO: 1415) | DIQMTQSPSSLSASVGDRVTITCRASQSILSYLN WYQQKPGKAPKLLIYAATSRASGVPSRFSGSGSG TDFTLTISSLQPEDFATYYCQQSDDTPLTFGGGT KVEIK (SEQ ID NO: 1508) |
| 369_A11 | EVQLLESGGGLVQPGGSLRLSCAASGFTF DSYGMNWVRQAPGKGLEWVANINYNGGYK GYADSVKGRFTISRDNSKNTLYLQMNSLR AEDTAVYYCARGATWHDTHLDYWGQGTLV TVSS (SEQ ID NO: 1416) | DIQMTQSPSSLSASVGDRVTITCRASQSIITYLN WYQQKPGKAPKLVIYAATSRHSGVPSRFSGSGSG TDFTLTISSLQPEDFATYYCQQSYESPLTFGGGT KVEIK (SEQ ID NO: 1509) |
| 369_C12 | EVQLLESGGGLVQPGGSLRLSCAASGFTF SSYGMNWVRQAPGKGLEWVANINYNGGYK GYADSVKGRFTISRDNSKNTLYLQMNSLR AEDTAVYYCARGATWHDTHLDYWGQGTLV TVSS (SEQ ID NO: 1417) | DIQMTQSPSSLSASVGDRVTITCRASQSILTYLN WYQQKPGKAPKLVIYAATSRHSGVPSRFSGSGSG TDFTLTISSLQPEDFATYYCQQSYDTPLTFGGGT KVEIK (SEQ ID NO: 1510) |
| 369_D08 | EVQLLESGGGLVQPGGSLRLSCAASGFTF SDYSMNWVRQAPGKGLEWVASINYNGGYK GYADSVKGRFTISRDNSKNTLYLQMNSLR AEDTAVYYCARGATWHDTHLDYWGQGTLV TVSS (SEQ ID NO: 1418) | DIQMTQSPSSLSASVGDRVTITCRASQSILTYLN WYQQKPGKAPKLLIYAATSRASGVPSRFSGSGSG TDFTLTISSLQPEDFATYYCQQSYDTPLTFGGGT KVEIK (SEQ ID NO: 1511) |
| 369_E05 | EVQLLESGGGLVQPGGSLRLSCAASGFTF SDYGMNWVRQAPGKGLEWVANINYNGGYK SYADSVKGRFTISRDNSKNTLYLQMNSLR AEDTAVYYCARGATWHDTHLDYWGQGTLV TVSS (SEQ ID NO: 1419) | DIQMTQSPSSLSASVGDRVTITCRASQSILTYLN WYQQKPGKAPKLLIYAATSLASGVPSRFSGSGSG TDFTLTISSLQPEDFATYYCQQSYETPLTFGGGT KVEIK (SEQ ID NO: 1512) |

TABLE 2D-continued

Group IV Antibody Sequences

| Ab | VH sequence | VL sequence |
|---|---|---|
| 369_E08 | EVQLLESGGGLVQPGGSLRLSCAASGFTF SSYSMNWVRQAPGKGLEWVASINYNSGYT GYADSVKGRFTISRDNSKNTLYLQMNSLR AEDTAVYYCARGATWHDTHLDYWGQGTLV TVSS (SEQ ID NO: 1420) | DIQMTQSPSSLSASVGDRVTITCRASQSILTYVN WYQQKPGKAPKLLIYAATSRASGVPSRFSGSGSG TDFTLTISSLQPEDFATYYCQQSYDSPLTFGGGT KVEIK (SEQ ID NO: 1513) |
| 369_F05 | EVQLLESGGGLVQPGGSLRLSCAASGFTF SSYSMNWVRQAPGKGLEWVSGINYNGGYK SYADSVKGRFTISRDNSKNTLYLQMNSLR AEDTAVYYCARGATWHDTHLDYWGQGTLV TVSS (SEQ ID NO: 1421) | DIQMTQSPSSLSASVGDRVTITCRASQSISSYLN WYQQKPGKAPKLLIYAASSLQSGVPSRFSGSGSG TDFTLTISSLQPEDFATYYCQQSYDSPLTFGGGT KVEIK (SEQ ID NO: 1514) |
| 369_F09 | EVQLLESGGGLVQPGGSLRLSCAASGFTF SSYGMHWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1422) | DIQMTQSPSSLSASVGDRVTITCRASQSILTYVN WYQQKPGKAPKLLIYAATSRASGVPSRFSGSGSG TDFTLTISSLQPEDFATYYCQQSYDSPLTFGGGT KVEIK (SEQ ID NO: 1515) |
| 369_G05 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1423) | DIQMTQSPSSLSASVGDRVTITCRASQSIVSYLN WYQQKPGKAPKLLIYAATSRHSGVPSRFSGSGSG TDFTLTISSLQPEDFATYYCQQSYDSPLTFGGGT KVEIK (SEQ ID NO: 1516) |
| 369_H02 | EVQLLESGGGLVQPGGSLRLSCAASGFTF DDYSMNWVRQAPGKGLEWVSNINYNGGYK SYADSVKGRFTISRDNSKNTLYLQMNSLR AEDTAVYYCARGATWHDTHLDYWGQGTLV TVSS (SEQ ID NO: 1424) | DIQMTQSPSSLSASVGDRVTITCRASQSIISYLN WYQQKPGKAPKLLIYAATSRASGVPSRFSGSGSG TDFTLTISSLQPEDFATYYCQQSYDSPLTFGGGT KVEIK (SEQ ID NO: 1517) |
| 369_H08 | EVQLLESGGGLVQPGGSLRLSCAASGFTF SSYSMNWVRQAPGKGLEWVAGINYNSGYK SYADSVKGRFTISRDNSKNTLYLQMNSLR AEDTAVYYCARGATWHDTHLDYWGQGTLV TVSS (SEQ ID NO: 1425) | DIQMTQSPSSLSASVGDRVTITCRASQSILSYVN WYQQKPGKAPKLVIYAATSLASGVPSRFSGSGSG TDFTLTISSLQPEDFATYYCQQSYESPLTFGGGT KVEIK (SEQ ID NO: 1518) |
| 369_H12 | EVQLLESGGGLVQPGGSLRLSCAASGFTF SSYSMNWVRQAPGKGLEWVAGINYNGGYK SYADSVKGRFTISRDNSKNTLYLQMNSLR AEDTAVYYCARGATWHDTHLDYWGQGTLV TVSS (SEQ ID NO: 1426) | DIQMTQSPSSLSASVGDRVTITCRASQSIVTYVN WYQQKPGKAPKLVIYAATSRASGVPSRFSGSGSG TDFTLTISSLQPEDFATYYCQQSYDSPLTFGGGT KVEIK (SEQ ID NO: 1519) |
| 370_B08 | EVQLLESGGGLVQPGGSLRLSCAASGFTF SDYSMNWVRQAPGKGLEWVANINYNGGYT GYADSVKGRFTISRDNSKNTLYLQMNSLR AEDTAVYYCARGATWHDTHLDYWGQGTLV TVSS (SEQ ID NO: 1427) | DIQMTQSPSSLSASVGDRVTITCRASQSILSYLN WYQQKPGKAPKLLIYAASSLQSGVPSRFSGSGSG TDFTLTISSLQPEDFATYYCQQSYDSPLTFGGGT KVEIK (SEQ ID NO: 1520) |
| 370_C06 | EVQLLESGGGLVQPGGSLRLSCAASGFTF SSYSMNWVRQAPGKGLEWVANINYNGGYK SYADSVKGRFTISRDNSKNTLYLQMNSLR AEDTAVYYCARGATWHDTHLDYWGQGTLV TVSS (SEQ ID NO: 1428) | DIQMTQSPSSLSASVGDRVTITCRASQSILTYVN WYQQKPGKAPKLLIYAASSLQSGVPSRFSGSGSG TDFTLTISSLQPEDFATYYCQQSYSTPLTFGGGT KVEIK (SEQ ID NO: 1521) |
| 370_C07 | EVQLLESGGGLVQPGGSLRLSCAASGFTF SSYSMNWVRQAPGKGLEWVANINYNGGYK SYADSVKGRFTISRDNSKNTLYLQMNSLR AEDTAVYYCARGATWHDTHLDYWGQGTLV TVSS (SEQ ID NO: 1429) | DIQMTQSPSSLSASVGDRVTITCRASQSILSYLN WYQQKPGKAPKLLIYAATSRHSGVPSRFSGSGSG TDFTLTISSLQPEDFATYYCQQSYESPLTFGGGT KVEIK (SEQ ID NO: 1522) |
| 370_C10 | EVQLLESGGGLVQPGGSLRLSCAASGFTF DSYSMNWVRQAPGKGLEWVSNINYNSGYK GYADSVKGRFTISRDNSKNTLYLQMNSLR AEDTAVYYCARGATWHDTHLDYWGQGTLV TVSS (SEQ ID NO: 1430) | DIQMTQSPSSLSASVGDRVTITCRASQSIVSYVN WYQQKPGKAPKLLIYATTSRASGVPSRFSGSGSG TDFTLTISSLQPEDFATYYCQQSYSSPLTFGGGT KVEIK (SEQ ID NO: 1523) |
| 370_D03 | EVQLLESGGGLVQPGGSLRLSCAASGFTF SSYSMNWVRQAPGKGLEWVASINYNGGYT SYADSVKGRFTISRDNSKNTLYLQMNSLR AEDTAVYYCARGATWHDTHLDYWGQGTLV TVSS (SEQ ID NO: 1431) | DIQMTQSPSSLSASVGDRVTITCRASQSIITYLN WYQQKPGKAPKLLIYAATSRASGVPSRFSGSGSG TDFTLTISSLQPEDFATYYCQQSYDLPLTFGGGT KVEIK (SEQ ID NO: 1524) |

TABLE 2D-continued

Group IV Antibody Sequences

| Ab | VH sequence | VL sequence |
|---|---|---|
| 370_D09 | EVQLLESGGGLVQPGGSLRLSCAASGFTF SDYSMNWVRQAPGKGLEWVSGINYNSGYT SYADSVKGRFTISRDNSKNTLYLQMNSLR AEDTAVYYCARGATWHDTHLDYWGQGTLV TVSS (SEQ ID NO: 1432) | DIQMTQSPSSLSASVGDRVTITCRASQSIVTYLN WYQQKPGKAPKLVIYAATSRASGVPSRFSGSGSG TDFTLTISSLQPEDFATYYCQQSYDTPLTFGGGT KVEIK (SEQ ID NO: 1525) |
| 370_E04 | EVQLLESGGGLVQPGGSLRLSCAASGFTF SSYSMNWVRQAPGKGLEWVANINYNGGYK GYADSVKGRFTISRDNSKNTLYLQMNSLR AEDTAVYYCARGATWHDTHLDYWGQGTLV TVSS (SEQ ID NO: 1433) | DIQMTQSPSSLSASVGDRVTITCRASQSILTYLN WYQQKPGKAPKLLIYAVTSLHSGVPSRFSGSGSG TDFTLTISSLQPEDFATYYCQQSYETPLTFGGGT KVEIK (SEQ ID NO: 1526) |
| 370_E05 | EVQLLESGGGLVQPGGSLRLSCAASGFTF SSYGMNWVRQAPGKGLEWVSNINYNGGYK GYADSVKGRFTISRDNSKNTLYLQMNSLR AEDTAVYYCARGATWHDTHLDYWGQGTLV TVSS (SEQ ID NO: 1434) | DIQMTQSPSSLSASVGDRVTITCRASQSISTYLN WYQQKPGKAPKLVIYAVTSRASGVPSRFSGSGSG TDFTLTISSLQPEDFATYYCQQSYNSPLTFGGGT KVEIK (SEQ ID NO: 1527) |
| 370_F01 | EVQLLESGGGLVQPGGSLRLSCAASGFTF SSYGMNWVRQAPGKGLEWVSNINYNGGYT SYADSVKGRFTISRDNSKNTLYLQMNSLR AEDTAVYYCARGATWHDTHLDYWGQGTLV TVSS (SEQ ID NO: 1435) | DIQMTQSPSSLSASVGDRVTITCRASQSIVSYLN WYQQKPGKAPKLLIYAATSRASGVPSRFSGSGSG TDFTLTISSLQPEDFATYYCQQSYDSPLTFGGGT KVEIK (SEQ ID NO: 1528) |
| 370_F02 | EVQLLESGGGLVQPGGSLRLSCAASGFTF DSYGMNWVRQAPGKGLEWVANINYNGGYT GYADSVKGRFTISRDNSKNTLYLQMNSLR AEDTAVYYCARGATWHDTHLDYWGQGTLV TVSS (SEQ ID NO: 1436) | DIQMTQSPSSLSASVGDRVTITCRASQSILSYLN WYQQKPGKAPKLLIYAVTSRHSGVPSRFSGSGSG TDFTLTISSLQPEDFATYYCQQSYDSPLTFGGGT KVEIK (SEQ ID NO: 1529) |
| 370_F12 | EVQLLESGGGLVQPGGSLRLSCAASGFTF SDYSMNWVRQAPGKGLEWVANINYNGGYT GYADSVKGRFTISRDNSKNTLYLQMNSLR AEDTAVYYCARGATWHDTHLDYWGQGTLV TVSS (SEQ ID NO: 1437) | DIQMTQSPSSLSASVGDRVTITCRASQSILSYLN WYQQKPGKAPKLLIYAASSLQSGVPSRFSGSGSG TDFTLTISSLQPEDFATYYCQQSYDSPLTFGGGT KVEIK (SEQ ID NO: 1530) |
| 370_G08 | EVQLLESGGGLVQPGGSLRLSCAASGFTF SDYSMNWVRQAPGKGLEWVAGINYNGGYT GYADSVKGRFTISRDNSKNTLYLQMNSLR AEDTAVYYCARGATWHDTHLDYWGQGTLV TVSS (SEQ ID NO: 1438) | DIQMTQSPSSLSASVGDRVTITCRASQSILTYLN WYQQKPGKAPKLVIYAATSRASGVPSRFSGSGSG TDFTLTISSLQPEDFATYYCQQSYESPLTFGGGT KVEIK (SEQ ID NO: 1531) |
| 370_H04 | EVQLLESGGGLVQPGGSLRLSCAASGFTF SSYSMNWVRQAPGKGLEWVSNINYNGGYT GYADSVKGRFTISRDNSKNTLYLQMNSLR AEDTAVYYCARGATWHDTHLDYWGQGTLV TVSS (SEQ ID NO: 1439) | DIQMTQSPSSLSASVGDRVTITCRASQSILSYVN WYQQKPGKAPKLLIYAATSRASGVPSRFSGSGSG TDFTLTISSLQPEDFATYYCQQSYDLPLTFGGGT KVEIK (SEQ ID NO: 1532) |
| 370_H06 | EVQLLESGGGLVQPGGSLRLSCAASGFTF DDYSMNWVRQAPGKGLEWVANINYNGGYT GYADSVKGRFTISRDNSKNTLYLQMNSLR AEDTAVYYCARGATWHDTHLDYWGQGTLV TVSS (SEQ ID NO: 1440) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 1533) |
| 371_B01 | EVQLLESGGGLVQPGGSLRLSCAASGFTF DSYSMNWVRQAPGKGLEWVSNINYNSGYT GYADSVKGRFTISRDNSKNTLYLQMNSLR AEDTAVYYCARGATWHDTHLDYWGQGTLV TVSS (SEQ ID NO: 1441) | DIQMTQSPSSLSASVGDRVTITCRASQSILSYVN WYQQKPGKAPKLLIYAATSLASGVPSRFSGSGSG TDFTLTISSLQPEDFATYYCQQSYDLPLTFGGGT KVEIK (SEQ ID NO: 1534) |
| 371_C06 | EVQLLESGGGLVQPGGSLRLSCAASGFTF SSYSMNWVRQAPGKGLEWVSSINYNGGYT SYADSVKGRFTISRDNSKNTLYLQMNSLR AEDTAVYYCARGATWHDTHLDYWGQGTLV TVSS (SEQ ID NO: 1442) | DIQMTQSPSSLSASVGDRVTITCRASQSISSYLN WYQQKPGKAPKLLIYAVTSRASGVPSRFSGSGSG TDFTLTISSLQPEDFATYYCQQSYDLPLTFGGGT KVEIK (SEQ ID NO: 1535) |
| 371_C07 | EVQLLESGGGLVQPGGSLRLSCAASGFTF DSYGMNWVRQAPGKGLEWVSNINYNGGYT GYADSVKGRFTISRDNSKNTLYLQMNSLR AEDTAVYYCARGATWHDTALDYWGQGTLV TVSS (SEQ ID NO: 1443) | DIQMTQSPSSLSASVGDRVTITCRASQSILSYLN WYQQKPGKAPKLLIYAATSLASGVPSRFSGSGSG TDFTLTISSLQPEDFATYYCQQSYDTPLTFGGGT KVEIK (SEQ ID NO: 1536) |

TABLE 2D-continued

Group IV Antibody Sequences

| Ab | VH sequence | VL sequence |
|---|---|---|
| 371_E05 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1444) | DIQMTQSPSSLSASVGDRVTITCRASQSIISYLN WYQQKPGKAPKLVIYAATSRASGVPSRFSGSGSG TDFTLTISSLQPEDFATYYCQQSYSSPLTFGGGT KVEIK (SEQ ID NO: 1537) |
| 371_E08 | EVQLLESGGGLVQPGGSLRLSCAASGFTF SSYSMNWVRQAPGKGLEWVSNINYNSGYK SYADSVKGRFTISRDNSKNTLYLQMNSLR AEDTAVYYCARGATWHDTHLDYWGQGTLV TVSS (SEQ ID NO: 1445) | DIQMTQSPSSLSASVGDRVTITCRASQSIVSYVN WYQQKPGKAPKLVIYAATSRHSGVPSRFSGSGSG TDFTLTISSLQPEDFATYYCQQSYDLPLTFGGGT KVEIK (SEQ ID NO: 1538) |
| 371_E09 | EVQLLESGGGLVQPGGSLRLSCAASGFTF SDYSMNWVRQAPGKGLEWVSGINYNSGYT SYADSVKGRFTISRDNSKNTLYLQMNSLR AEDTAVYYCARGATWHDTHLDYWGQGTLV TVSS (SEQ ID NO: 1446) | DIQMTQSPSSLSASVGDRVTITCRASQSILTYLN WYQQKPGKAPKLLIYAATSRASGVPSRFSGSGSG TDFTLTISSLQPEDFATYYCQQSYNSPLTFGGGT KVEIK (SEQ ID NO: 1539) |
| 371_E12 | EVQLLESGGGLVQPGGSLRLSCAASGFTF DSYSMNWVRQAPGKGLEWVSGINYNSGYK SYADSVKGRFTISRDNSKNTLYLQMNSLR AEDTAVYYCARGATWHDTHLDYWGQGTLV TVSS (SEQ ID NO: 1447) | DIQMTQSPSSLSASVGDRVTITCRASQSILSYLN WYQQKPGKAPKLLIYAATSLASGVPSRFSGSGSG TDFTLTISSLQPEDFATYYCQQSYDTPLTFGGGT KVEIK (SEQ ID NO: 1540) |
| 371_F03 | EVQLLESGGGLVQPGGSLRLSCAASGFTF SSYSMNWVRQAPGKGLEWVSGINYNGGYT SYADSVKGRFTISRDNSKNTLYLQMNSLR AEDTAVYYCARGATWHDTHLDYWGQGTLV TVSS (SEQ ID NO: 1448) | DIQMTQSPSSLSASVGDRVTITCRASQSIITYLN WYQQKPGKAPKLLIYAATSLHSGVPSRFSGSGSG TDFTLTISSLQPEDFATYYCQQSYDNPLTFGGGT KVEIK (SEQ ID NO: 1541) |
| 371_F09 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1449) | DIQMTQSPSSLSASVGDRVTITCRASQSILTYLN WYQQKPGKAPKLLIYAATSRASGVPSRFSGSGSG TDFTLTISSLQPEDFATYYCQQSYDNPLTFGGGT KVEIK (SEQ ID NO: 1542) |
| 371_G01 | EVQLLESGGGLVQPGGSLRLSCAASGFTF SDYSMNWVRQAPGKGLEWVSNINYNGGYT SYADSVKGRFTISRDNSKNTLYLQMNSLR AEDTAVYYCARGATWHDTHLDYWGQGTLV TVSS (SEQ ID NO: 1450) | DIQMTQSPSSLSASVGDRVTITCRASQSILTYLN WYQQKPGKAPKLLIYAATSLASGVPSRFSGSGSG TDFTLTISSLQPEDFATYYCQQSYDLPLTFGGGT KVEIK (SEQ ID NO: 1543) |
| 371_H11 | EVQLLESGGGLVQPGGSLRLSCAASGFTF SSYSMNWVRQAPGKGLEWVSGINYNGGYK GYADSVKGRFTISRDNSKNTLYLQMNSLR AEDTAVYYCARGATWHDTHLDYWGQGTLV TVSS (SEQ ID NO: 1451) | DIQMTQSPSSLSASVGDRVTITCRASQSILTYLN WYQQKPGKAPKLLIYATTSRHSGVPSRFSGSGSG TDFTLTISSLQPEDFATYYCQQSYESPLTFGGGT KVEIK (SEQ ID NO: 1544) |
| 372_B09 | EVQLLESGGGLVQPGGSLRLSCAASGFTF SSYSMNWVRQAPGKGLEWVSSINYNSGYT SYADSVKGRFTISRDNSKNTLYLQMNSLR AEDTAVYYCARGATWHDTHLDYWGQGTLV TVSS (SEQ ID NO: 1452) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 1545) |
| 372_E08 | EVQLLESGGGLVQPGGSLRLSCAASGFTF SDYSMNWVRQAPGKGLEWVSNINYNGGYT SYADSVKGRFTISRDNSKNTLYLQMNSLR AEDTAVYYCARGATWHDTHLDYWGQGTLV TVSS (SEQ ID NO: 1453) | DIQMTQSPSSLSASVGDRVTITCRASQSIITYLN WYQQKPGKAPKLLIYAATSRASGVPSRFSGSGSG TDFTLTISSLQPEDFATYYCQQSYNLPLTFGGGT KVEIK (SEQ ID NO: 1546) |
| 372_F02 | EVQLLESGGGLVQPGGSLRLSCAASGFTF SSYGMHWVRQAPGKGLEWVASINYNGGYT SYADSVKGRFTISRDNSKNTLYLQMNSLR AEDTAVYYCARGATWHDTHLDYWGQGTLV TVSS (SEQ ID NO: 1454) | DIQMTQSPSSLSASVGDRVTITCRASQSILTYLN WYQQKPGKAPKLVIYAATSRHSGVPSRFSGSGSG TDFTLTISSLQPEDFATYYCQQSYDLPLTFGGGT KVEIK (SEQ ID NO: 1547) |
| 372_H11 | EVQLLESGGGLVQPGGSLRLSCAASGFTF SSYGMHWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1455) | DIQMTQSPSSLSASVGDRVTITCRASQSILSYVN WYQQKPGKAPKLLIYAATSRASGVPSRFSGSGSG TDFTLTISSLQPEDFATYYCQQSYENPLTFGGGT KVEIK (SEQ ID NO: 1548) |

TABLE 2D-continued

Group IV Antibody Sequences

| Ab | VH sequence | VL sequence |
|---|---|---|
| 373_A06 | EVQLLESGGGLVQPGGSLRLSCAASGFTF SSYSMNWVRQAPGKGLEWVSGINYNGGYK SYADSVKGRFTISRDNSKNTLYLQMNSLR AEDTAVYYCARGATWHDTHLDYWGQGTLV TVSS (SEQ ID NO: 1456) | DIQMTQSPSSLSASVGDRVTITCRASQSIVTYLN WYQQKPGKAPKLLIYAASSLQSGVPSRFSGSGSG TDFTLTISSLQPEDFATYYCQQSYSTPLTFGGGT KVEIK (SEQ ID NO: 1549) |
| 373_B09 | EVQLLESGGGLVQPGGSLRLSCAASGFTF DSYSMNWVRQAPGKGLEWVSGINYNGGYK SYADSVKGRFTISRDNSKNTLYLQMNSLR AEDTAVYYCARGATWHDTHLDYWGQGTLV TVSS (SEQ ID NO: 1457) | DIQMTQSPSSLSASVGDRVTITCRASQSILSYLN WYQQKPGKAPKLVIYAATSLASGVPSRFSGSGSG TDFTLTISSLQPEDFATYYCQQSYETPLTFGGGT KVEIK (SEQ ID NO: 1550) |
| 373_D06 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1458) | DIQMTQSPSSLSASVGDRVTITCRASQSIVTYLN WYQQKPGKAPKLLIYAATSRASGVPSRFSGSGSG TDFTLTISSLQPEDFATYYCQQSYDTPLTFGGGT KVEIK (SEQ ID NO: 1551) |
| 373_F07 | EVQLLESGGGLVQPGGSLRLSCAASGFTF SSYSMNWVRQAPGKGLEWVSGINYNSGYK SYADSVKGRFTISRDNSKNTLYLQMNSLR AEDTAVYYCARGATWHDTHLDYWGQGTLV TVSS (SEQ ID NO: 1459) | DIQMTQSPSSLSASVGDRVTITCRASQSILSYLN WYQQKPGKAPKLLIYAATSLASGVPSRFSGSGSG TDFTLTISSLQPEDFATYYCQQSYETPLTFGGGT KVEIK (SEQ ID NO: 1552) |
| 373_G02 | EVQLLESGGGLVQPGGSLRLSCAASGFTF SSYSMNWVRQAPGKGLEWVSGINYNGGYT SYADSVKGRFTISRDNSKNTLYLQMNSLR AEDTAVYYCARGATWHDTHLDYWGQGTLV TVSS (SEQ ID NO: 1460) | DIQMTQSPSSLSASVGDRVTITCRASQSIITYLN WYQQKPGKAPKLLIYAATSRASGVPSRFSGSGSG TDFTLTISSLQPEDFATYYCQQSYSSPLTFGGGT KVEIK (SEQ ID NO: 1553) |
| 374_A04 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1461) | DIQMTQSPSSLSASVGDRVTITCRASQSILTYLN WYQQKPGKAPKLVIYAATSRASGVPSRFSGSGSG TDFTLTISSLQPEDFATYYCQQSYDTPLTFGGGT KVEIK (SEQ ID NO: 1554) |
| 374_A05 | EVQLLESGGGLVQPGGSLRLSCAASGFTF SDYGMNWVRQAPGKGLEWVANINYNGGYK GYADSVKGRFTISRDNSKNTLYLQMNSLR AEDTAVYYCARGATWHDTHLDYWGQGTLV TVSS (SEQ ID NO: 1462) | DIQMTQSPSSLSASVGDRVTITCRASQSIVRYLN WYQQKPGKAPKLVIYAATSLASGVPSRFSGSGSG TDFTLTISSLQPEDFATYYCQQSYELPLTFGGGT KVEIK (SEQ ID NO: 1555) |
| 374_C10 | EVQLLESGGGLVQPGGSLRLSCAASGFTF SSYSMNWVRQAPGKGLEWVSSINYNGGYK GYADSVKGRFTISRDNSKNTLYLQMNSLR AEDTAVYYCARGATWHDTHLDYWGQGTLV TVSS (SEQ ID NO: 1463) | DIQMTQSPSSLSASVGDRVTITCRASQSIVTYLN WYQQKPGKAPKLLIYAATSLASGVPSRFSGSGSG TDFTLTISSLQPEDFATYYCQQSYNTPLTFGGGT KVEIK (SEQ ID NO: 1556) |
| 374_D04 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1464) | DIQMTQSPSSLSASVGDRVTITCRASQSILSYLN WYQQKPGKAPKLVIYAATSRHSGVPSRFSGSGSG TDFTLTISSLQPEDFATYYCQQSYDTPLTFGGGT KVEIK (SEQ ID NO: 1557) |
| 374_D09 | EVQLLESGGGLVQPGGSLRLSCAASGFTF DSYGMNWVRQAPGKGLEWVANINYNGGYK GYADSVKGRFTISRDNSKNTLYLQMNSLR AEDTAVYYCARGATWHDTHLDYWGQGTLV TVSS (SEQ ID NO: 1465) | DIQMTQSPSSLSASVGDRVTITCRASQSIISYVN WYQQKPGKAPKLVIYAATSLASGVPSRFSGSGSG TDFTLTISSLQPEDFATYYCQQSYDTPLTFGGGT KVEIK (SEQ ID NO: 1558) |
| 374_G05 | EVQLLESGGGLVQPGGSLRLSCAASGFTF SSYSMNWVRQAPGKGLEWVSNINYNSGYK GYADSVKGRFTISRDNSKNTLYLQMNSLR AEDTAVYYCARGATWHDTHLDYWGQGTLV TVSS (SEQ ID NO: 1466) | DIQMTQSPSSLSASVGDRVTITCRASQSIISYLN WYQQKPGKAPKLLIYAATSRASGVPSRFSGSGSG TDFTLTISSLQPEDFATYYCQQSYDLPLTFGGGT KVEIK (SEQ ID NO: 1559) |
| 374_H05 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1467) | DIQMTQSPSSLSASVGDRVTITCRASQSILSYVN WYQQKPGKAPKLVIYAATSRASGVPSRFSGSGSG TDFTLTISSLQPEDFATYYCQQSYDNPLTFGGGT KVEIK (SEQ ID NO: 1560) |

TABLE 2D-continued

Group IV Antibody Sequences

| Ab | VH sequence | VL sequence |
|---|---|---|
| 375_A03 | EVQLLESGGGLVQPGGSLRLSCAASGFTF DSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1468) | DIQMTQSPSSLSASVGDRVTITCRASQSILTYLN WYQQKPGKAPKLLIYAATSRHSGVPSRFSGSGSG TDFTLTISSLQPEDFATYYCQQSYDNPLTFGGGT KVEIK (SEQ ID NO: 1561) |
| 375_B03 | EVQLLESGGGLVQPGGSLRLSCAASGFTF SSYSMNWVRQAPGKGLEWVAGINYNGGYT SYADSVKGRFTISRDNSKNTLYLQMNSLR AEDTAVYYCARGATWHDTHLDYWGQGTLV TVSS (SEQ ID NO: 1469) | DIQMTQSPSSLSASVGDRVTITCRASQSILTYLN WYQQKPGKAPKLLIYAATSRASGVPSRFSGSGSG TDFTLTISSLQPEDFATYYCQQSYDSPLTFGGGT KVEIK (SEQ ID NO: 1562) |
| 375_C01 | EVQLLESGGGLVQPGGSLRLSCAASGFTF SSYGMNWVRQAPGKGLEWVSSINYNGGYK GYADSVKGRFTISRDNSKNTLYLQMNSLR AEDTAVYYCARGATWHDTHLDYWGQGTLV TVSS (SEQ ID NO: 1470) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 1563) |
| 375_C11 | EVQLLESGGGLVQPGGSLRLSCAASGFTF SSYSMNWVRQAPGKGLEWVSSINYNGGYT SYADSVKGRFTISRDNSKNTLYLQMNSLR AEDTAVYYCARGATWHDTHLDYWGQGTLV TVSS (SEQ ID NO: 1471) | DIQMTQSPSSLSASVGDRVTITCRASQSILSYVN WYQQKPGKAPKLLIYAATSRHSGVPSRFSGSGSG TDFTLTISSLQPEDFATYYCQQSYDTPLTFGGGT KVEIK (SEQ ID NO: 1564) |
| 375_F10 | EVQLLESGGGLVQPGGSLRLSCAASGFTF SSYSMNWVRQAPGKGLEWVSGINYNGGYT GYADSVKGRFTISRDNSKNTLYLQMNSLR AEDTAVYYCARGATWHDTHLDYWGQGTLV TVSS (SEQ ID NO: 1472) | DIQMTQSPSSLSASVGDRVTITCRASQSILTYLN WYQQKPGKAPKLVIYAATSRASGVPSRFSGSGSG TDFTLTISSLQPEDFATYYCQQSYDTPLTFGGGT KVEIK (SEQ ID NO: 1565) |
| 375_H08 | EVQLLESGGGLVQPGGSLRLSCAASGFTF SSYSMNWVRQAPGKGLEWVSGINYNGGYT SYADSVKGRFTISRDNSKNTLYLQMNSLR AEDTAVYYCARGATWHDTHLDYWGQGTLV TVSS (SEQ ID NO: 1473) | DIQMTQSPSSLSASVGDRVTITCRASQSILTYLN WYQQKPGKAPKLLIYAATSLASGVPSRFSGSGSG TDFTLTISSLQPEDFATYYCQQSYDSPLTFGGGT KVEIK (SEQ ID NO: 1566) |
| 376_A02 | EVQLLESGGGLVQPGGSLRLSCAASGFTF SSYSMNWVRQAPGKGLEWVAGINYNGGYK SYADSVKGRFTISRDNSKNTLYLQMNSLR AEDTAVYYCARGATWHDTHLDYWGQGTLV TVSS (SEQ ID NO: 1474) | DIQMTQSPSSLSASVGDRVTITCRASQSILSYLN WYQQKPGKAPKLLIYAATSRASGVPSRFSGSGSG TDFTLTISSLQPEDFATYYCQQSYDLPLTFGGGT KVEIK (SEQ ID NO: 1567) |
| 376_A05 | EVQLLESGGGLVQPGGSLRLSCAASGFTF SSYSMNWVRQAPGKGLEWVAGINYNSGYK GYADSVKGRFTISRDNSKNTLYLQMNSLR AEDTAVYYCARGATWHDTHLDYWGQGTLV TVSS (SEQ ID NO: 1475) | DIQMTQSPSSLSASVGDRVTITCRASQSILTYLN WYQQKPGKAPKLLIYAATSRASGVPSRFSGSGSG TDFTLTISSLQPEDFATYYCQQSYNTPLTFGGGT KVEIK (SEQ ID NO: 1568) |
| 376_A07 | EVQLLESGGGLVQPGGSLRLSCAASGFTF SSYSMNWVRQAPGKGLEWVSGINYNGGYK SYADSVKGRFTISRDNSKNTLYLQMNSLR AEDTAVYYCARGATWHDTHLDYWGQGTLV TVSS (SEQ ID NO: 1476) | DIQMTQSPSSLSASVGDRVTITCRASQSILTYLN WYQQKPGKAPKLLIYAATSRASGVPSRFSGSGSG TDFTLTISSLQPEDFATYYCQQSYDSPLTFGGGT KVEIK (SEQ ID NO: 1569) |

Table 3D provides the amino acid sequences of the CDRs of the antibodies shown in Table 2D.

TABLE 3D

CDR sequences for Group IV antibodies

| Ab | HCDR1 | HCDR2 | HCDR3 | LCDR1 | LCDR2 | LCDR3 |
|---|---|---|---|---|---|---|
| 365_A08 | SSYSMN (SEQ ID NO: 1570) | WVASINYNGGYKS (SEQ ID NO: 1663) | ARGATWHDTHLD (SEQ ID NO: 1756) | ITYLNWY (SEQ ID NO: 1849) | LVIYAATSRA (SEQ ID NO: 1942) | QQSDNTPL (SEQ ID NO: 2035) |
| 365_A09 | SSYGMH (SEQ ID NO: 1571) | WVASINYNGGYTS (SEQ ID NO: 1664) | ARGATWHDTHLD (SEQ ID NO: 1757) | LSYVNWY (SEQ ID NO: 1850) | LLIYAATSRA (SEQ ID NO: 1943) | QQSYDLPL (SEQ ID NO: 2036) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 365_C02 | DSYSMN (SEQ ID NO: 1572) | WVSNINYNGGYKG (SEQ ID NO: 1665) | ARGATWHDTHLD (SEQ ID NO: 1758) | STYLNWY (SEQ ID NO: 1851) | LVIYAATSRH (SEQ ID NO: 1944) | QQSYENPL (SEQ ID NO: 2037) |
| 365_C04 | DSYSMN (SEQ ID NO: 1573) | WVANINYNGGYKG (SEQ ID NO: 1666) | ARGATWHDTHLD (SEQ ID NO: 1759) | LTYLNWY (SEQ ID NO: 1852) | LVIYAATSLA (SEQ ID NO: 1945) | QQSYDTPL (SEQ ID NO: 2038) |
| 365_D02 | SSYSMH (SEQ ID NO: 1574) | WVASINYNGGYTS (SEQ ID NO: 1667) | ARGATWHDTHLD (SEQ ID NO: 1760) | VTYLNWY (SEQ ID NO: 1853) | LLIYAATSLA (SEQ ID NO: 1946) | QQSYDNPL (SEQ ID NO: 2039) |
| 365_D07 | SSYGMN (SEQ ID NO: 1575) | WVSSINYNSGYKS (SEQ ID NO: 1668) | ARGATWHDTHLD (SEQ ID NO: 1761) | SSYLNWY (SEQ ID NO: 1854) | LLIYAASSLQ (SEQ ID NO: 1947) | QQSYSTPL (SEQ ID NO: 2040) |
| 365_D10 | SSYSMN (SEQ ID NO: 1576) | WVAGINYNGGYTG (SEQ ID NO: 1669) | ARGATWHDTHLD (SEQ ID NO: 1762) | STYLNWY (SEQ ID NO: 1855) | LLIYAATSRA (SEQ ID NO: 1948) | QQSYESPL (SEQ ID NO: 2041) |
| 365_E11 | DDYSMN (SEQ ID NO: 1577) | WVSSINYNGGYKS (SEQ ID NO: 1670) | ARGATWHDTHLD (SEQ ID NO: 1763) | SSYLNWY (SEQ ID NO: 1856) | LLIYAASSLQ (SEQ ID NO: 1949) | QQSYNTPL (SEQ ID NO: 2042) |
| 365_F05 | SSYGMN (SEQ ID NO: 1578) | WVASINYNGGYTS (SEQ ID NO: 1671) | ARGATWHDTHLD (SEQ ID NO: 1764) | VTYVNWY (SEQ ID NO: 1857) | LLIYAATSRA (SEQ ID NO: 1950) | QQSYETPL (SEQ ID NO: 2043) |
| 365_H05 | SSYGMN (SEQ ID NO: 1579) | WVAGINYNGGYTS (SEQ ID NO: 1672) | ARGATWHDTHLD (SEQ ID NO: 1765) | LTYVNWY (SEQ ID NO: 1858) | LLIYAATSLH (SEQ ID NO: 1951) | QQSYSTPL (SEQ ID NO: 2044) |
| 366_D08 | SSYGMH (SEQ ID NO: 1580) | WVSNINYNGGYKS (SEQ ID NO: 1673) | ARGATWHDTHLD (SEQ ID NO: 1766) | LSYVNWY (SEQ ID NO: 1859) | LVIYAATSLA (SEQ ID NO: 1952) | QQSYENPL (SEQ ID NO: 2045) |
| 366_F08 | SSYGMN (SEQ ID NO: 1581) | WVSSINYNGGYTS (SEQ ID NO: 1674) | ARGATWHDTHLD (SEQ ID NO: 1767) | SSYLNWY (SEQ ID NO: 1860) | LLIYAASSLQ (SEQ ID NO: 1953) | QQSYSTPL (SEQ ID NO: 2046) |
| 366_G09 | DDYSMN (SEQ ID NO: 1582) | WVASINYNSGYTG (SEQ ID NO: 1675) | ARGATWHDTHLD (SEQ ID NO: 1768) | LSYVNWY (SEQ ID NO: 1861) | LVIYAATSRA (SEQ ID NO: 1954) | QQSYDLPL (SEQ ID NO: 2047) |
| 367_A02 | DSYGMN (SEQ ID NO: 1583) | WVSSINYNSGYKG (SEQ ID NO: 1676) | ARGATWHDTHLD (SEQ ID NO: 1769) | ISYLNWY (SEQ ID NO: 1862) | LLIYAVTSRA (SEQ ID NO: 1955) | QQSYDTPL (SEQ ID NO: 2048) |
| 367_B06 | SSYSMN (SEQ ID NO: 1584) | WVANINYNGGYTG (SEQ ID NO: 1677) | ARGATWHDTHLD (SEQ ID NO: 1770) | ISYVNWY (SEQ ID NO: 1863) | LVIYAATSLH (SEQ ID NO: 1956) | QQSYNSPL (SEQ ID NO: 2049) |
| 367_C08 | DSYSMH (SEQ ID NO: 1585) | WVAGINYNGGYTS (SEQ ID NO: 1678) | ARGATWHDTHLD (SEQ ID NO: 1771) | LTYLNWY (SEQ ID NO: 1864) | LLIYAATSLA (SEQ ID NO: 1957) | QQSDSNPL (SEQ ID NO: 2050) |
| 367_D05 | SDYSMN (SEQ ID NO: 1586) | WVSSINYNGGYKS (SEQ ID NO: 1679) | ARGATWHDTHLD (SEQ ID NO: 1772) | ISYVNWY (SEQ ID NO: 1865) | LVIYAATSLA (SEQ ID NO: 1958) | QQSYDSPL (SEQ ID NO: 2051) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 367_D09 | DSYGMN (SEQ ID NO: 1587) | WVASINYNGGYKS (SEQ ID NO: 1680) | ARGATWHDTHLD (SEQ ID NO: 1773) | LTYLNWY (SEQ ID NO: 1866) | LLIYAATSLA (SEQ ID NO: 1959) | QQSYDNPL (SEQ ID NO: 2052) |
| 367_E07 | SDYSMN (SEQ ID NO: 1588) | WVSSINYNGGYKG (SEQ ID NO: 1681) | ARGATWHDTHLD (SEQ ID NO: 1774) | LSYVNWY (SEQ ID NO: 1867) | LVIYAATSRA (SEQ ID NO: 1960) | QQSYENPL (SEQ ID NO: 2053) |
| 367_E12 | SSYGMH (SEQ ID NO: 1589) | WVASINYNGGYTS (SEQ ID NO: 1682) | ARGATWHDTHLD (SEQ ID NO: 1775) | LTYVNWY (SEQ ID NO: 1868) | LLIYAASSLQ (SEQ ID NO: 1961) | QQSYNSPL (SEQ ID NO: 2054) |
| 367_F09 | DSYSMH (SEQ ID NO: 1590) | WVAGINYNGGYTS (SEQ ID NO: 1683) | ARGATWHDTHLD (SEQ ID NO: 1776) | LTYLNWY (SEQ ID NO: 1869) | LLIYAATSLA (SEQ ID NO: 1962) | QQSDSNPL (SEQ ID NO: 2055) |
| 367_H05 | SSYGMH (SEQ ID NO: 1591) | WVASINYNSGYKS (SEQ ID NO: 1684) | ARGATWHDTHLD (SEQ ID NO: 1777) | LSYVNWY (SEQ ID NO: 1870) | LLIYAASSLQ (SEQ ID NO: 1963) | QQSYSTPL (SEQ ID NO: 2056) |
| 367_H10 | SSYGMN (SEQ ID NO: 1592) | WVASINYNGGYTG (SEQ ID NO: 1685) | ARGATWHDTHLD (SEQ ID NO: 1778) | LSYVNWY (SEQ ID NO: 1871) | LVIYAATSRA (SEQ ID NO: 1964) | QQSYELPL (SEQ ID NO: 2057) |
| 368_B02 | SSYGMN (SEQ ID NO: 1593) | WVSGINYNSGYKS (SEQ ID NO: 1686) | ARGATWHDTHLD (SEQ ID NO: 1779) | SSYLNWY (SEQ ID NO: 1872) | LLIYAASSLQ (SEQ ID NO: 1965) | QQSYSTPL (SEQ ID NO: 2058) |
| 368_C11 | SDYSMN (SEQ ID NO: 1594) | WVSSINYNSGYKS (SEQ ID NO: 1687) | ARGATWHDTHLD (SEQ ID NO: 1780) | ISYLNWY (SEQ ID NO: 1873) | LLIYAATSRA (SEQ ID NO: 1966) | QQSYDNPL (SEQ ID NO: 2059) |
| 368_D02 | DDYGMN (SEQ ID NO: 1595) | WVSNINYNGGYTG (SEQ ID NO: 1688) | ARGATWHDTHLD (SEQ ID NO: 1781) | STYLNWY (SEQ ID NO: 1874) | LVIYAATSRH (SEQ ID NO: 1967) | QQSYDTPL (SEQ ID NO: 2060) |
| 368_D12 | SSYGMN (SEQ ID NO: 1596) | WVSSINYNGGYTS (SEQ ID NO: 1689) | ARGATWHDTHLD (SEQ ID NO: 1782) | LSYVNWY (SEQ ID NO: 1875) | LVIYAATSRA (SEQ ID NO: 1968) | QQSYNNPL (SEQ ID NO: 2061) |
| 368_F06 | DDYSMH (SEQ ID NO: 1597) | WVANINYNSGYTG (SEQ ID NO: 1690) | ARGATWHDTHLD (SEQ ID NO: 1783) | LSYLNWY (SEQ ID NO: 1876) | LVIYATTSRA (SEQ ID NO: 1969) | QQSYENPL (SEQ ID NO: 2062) |
| 368_G03 | SSYSMN (SEQ ID NO: 1598) | WVSGINYNSGYTS (SEQ ID NO: 1691) | ARGATWHDTALD (SEQ ID NO: 1784) | LSYLNWY (SEQ ID NO: 1877) | LVIYAATSRA (SEQ ID NO: 1970) | QQSYDTPL (SEQ ID NO: 2063) |
| 368_G10 | SSYSMH (SEQ ID NO: 1599) | WVSSINYNGGYTS (SEQ ID NO: 1692) | ARGATWHDTHLD (SEQ ID NO: 1785) | VSYVNWY (SEQ ID NO: 1878) | LVIYAATSRA (SEQ ID NO: 1971) | QQSYDTPL (SEQ ID NO: 2064) |
| 368_H06 | DSYGMH (SEQ ID NO: 1600) | WVANINYNGGYKS (SEQ ID NO: 1693) | ARGATWHDTHLD (SEQ ID NO: 1786) | LTYVNWY (SEQ ID NO: 1879) | LLIYATTSRA (SEQ ID NO: 1972) | QQSYDNPL (SEQ ID NO: 2065) |
| 368_H11 | DSYGMH (SEQ ID NO: 1601) | WVASINYNGGYTS (SEQ ID NO: 1694) | ARGATWHDTHLD (SEQ ID NO: 1787) | LSYLNWY (SEQ ID NO: 1880) | LLIYAATSRA (SEQ ID NO: 1973) | QQSDDTPL (SEQ ID NO: 2066) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 369_A11 | DSYGMN (SEQ ID NO: 1602) | WVANINYNGGYKG (SEQ ID NO: 1695) | ARGATWHDTHLD (SEQ ID NO: 1788) | ITYLNWY (SEQ ID NO: 1881) | LVIYAATSRH (SEQ ID NO: 1974) | QQSYESPL (SEQ ID NO: 2067) |
| 369_C12 | SSYGMN (SEQ ID NO: 1603) | WVANINYNGGYKG (SEQ ID NO: 1696) | ARGATWHDTHLD (SEQ ID NO: 1789) | LTYLNWY (SEQ ID NO: 1882) | LLIYAATSRH (SEQ ID NO: 1975) | QQSYDTPL (SEQ ID NO: 2068) |
| 369_D08 | SDYSMN (SEQ ID NO: 1604) | WVASINYNGGYKG (SEQ ID NO: 1697) | ARGATWHDTHLD (SEQ ID NO: 1790) | LTYLNWY (SEQ ID NO: 1883) | LLIYAATSRA (SEQ ID NO: 1976) | QQSYDTPL (SEQ ID NO: 2069) |
| 369_E05 | SDYGMN (SEQ ID NO: 1605) | WVANINYNGGYKS (SEQ ID NO: 1698) | ARGATWHDTHLD (SEQ ID NO: 1791) | LTYLNWY (SEQ ID NO: 1884) | LLIYAATSLA (SEQ ID NO: 1977) | QQSYETPL (SEQ ID NO: 2070) |
| 369_E08 | SSYSMN (SEQ ID NO: 1606) | WVASINYNSGYTG (SEQ ID NO: 1699) | ARGATWHDTHLD (SEQ ID NO: 1792) | LTYVNWY (SEQ ID NO: 1885) | LLIYAATSRA (SEQ ID NO: 1978) | QQSYDSPL (SEQ ID NO: 2071) |
| 369_F05 | SSYSMN (SEQ ID NO: 1607) | WVSGINYNGGYKS (SEQ ID NO: 1700) | ARGATWHDTHLD (SEQ ID NO: 1793) | SSYLNWY (SEQ ID NO: 1886) | LLIYAASSLQ (SEQ ID NO: 1979) | QQGYDSPL (SEQ ID NO: 2072) |
| 369_F09 | SSYGMH (SEQ ID NO: 1608) | WVAGINYNGGYTS (SEQ ID NO: 1701) | ARGATWHDTHLD (SEQ ID NO: 1794) | LTYVNWY (SEQ ID NO: 1887) | LLIYAATSRA (SEQ ID NO: 1980) | QQSYDSPL (SEQ ID NO: 2073) |
| 369_G05 | SSYSMN (SEQ ID NO: 1609) | WVAGINYNGGYTS (SEQ ID NO: 1702) | ARGATWHDTHLD (SEQ ID NO: 1795) | VSYLNWY (SEQ ID NO: 1888) | LLIYAATSRH (SEQ ID NO: 1981) | QQSYDSPL (SEQ ID NO: 2074) |
| 369_H02 | DDYSMN (SEQ ID NO: 1610) | WVSNINYNGGYKS (SEQ ID NO: 1703) | ARGATWHDTHLD (SEQ ID NO: 1796) | ISYLNWY (SEQ ID NO: 1889) | LLIYAATSRA (SEQ ID NO: 1982) | QQSYDSPL (SEQ ID NO: 2075) |
| 369_H08 | SSYSMN (SEQ ID NO: 1611) | WVAGINYNSGYKS (SEQ ID NO: 1704) | ARGATWHDTHLD (SEQ ID NO: 1797) | LSYVNWY (SEQ ID NO: 1890) | LVIYAATSLA (SEQ ID NO: 1983) | QQSYESPL (SEQ ID NO: 2076) |
| 369_H12 | SSYSMN (SEQ ID NO: 1612) | WVAGINYNGGYKS (SEQ ID NO: 1705) | ARGATWHDTHLD (SEQ ID NO: 1798) | VTYVNWY (SEQ ID NO: 1891) | LVIYAATSRA (SEQ ID NO: 1984) | QQSYDSPL (SEQ ID NO: 2077) |
| 370_B08 | SDYSMN (SEQ ID NO: 1613) | WVANINYNGGYTG (SEQ ID NO: 1706) | ARGATWHDTHLD (SEQ ID NO: 1799) | LSYLNWY (SEQ ID NO: 1892) | LLIYAASSLQ (SEQ ID NO: 1985) | QQSYDSPL (SEQ ID NO: 2078) |
| 370_C06 | SSYSMN (SEQ ID NO: 1614) | WVANINYNGGYKS (SEQ ID NO: 1707) | ARGATWHDTHLD (SEQ ID NO: 1800) | LTYVNWY (SEQ ID NO: 1893) | LLIYAASSLQ (SEQ ID NO: 1986) | QQSYSTPL (SEQ ID NO: 2079) |
| 370_C07 | SSYSMN (SEQ ID NO: 1615) | WVANINYNGGYKS (SEQ ID NO: 1708) | ARGATWHDTHLD (SEQ ID NO: 1801) | LSYLNWY (SEQ ID NO: 1894) | LLIYAATSRH (SEQ ID NO: 1987) | QQSYESPL (SEQ ID NO: 2080) |
| 370_C10 | DSYSMN (SEQ ID NO: 1616) | WVSNINYNSGYKG (SEQ ID NO: 1709) | ARGATWHDTHLD (SEQ ID NO: 1802) | VSYVNWY (SEQ ID NO: 1895) | LLIYATTSRA (SEQ ID NO: 1988) | QQSYSSPL (SEQ ID NO: 2081) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 370_D03 | SSYSMN (SEQ ID NO: 1617) | WVASINYNGGYTS (SEQ ID NO: 1710) | ARGATWHDTHLD (SEQ ID NO: 1803) | ITYLNWY (SEQ ID NO: 1896) | LLIYAATSRA (SEQ ID NO: 1989) | QQSYDLPL (SEQ ID NO: 2082) |
| 370_D09 | SDYSMN (SEQ ID NO: 1618) | WVSGINYNSGYTS (SEQ ID NO: 1711) | ARGATWHDTHLD (SEQ ID NO: 1804) | VTYLNWY (SEQ ID NO: 1897) | LVIYAATSRA (SEQ ID NO: 1990) | QQSYDTPL (SEQ ID NO: 2083) |
| 370_E04 | SSYSMN (SEQ ID NO: 1619) | WVANINYNGGYKG (SEQ ID NO: 1712) | ARGATWHDTHLD (SEQ ID NO: 1805) | LTYLNWY (SEQ ID NO: 1898) | LLIYAVTSLH (SEQ ID NO: 1991) | QQSYETPL (SEQ ID NO: 2084) |
| 370_E05 | SSYGMN (SEQ ID NO: 1620) | WVSNINYNGGYKG (SEQ ID NO: 1713) | ARGATWHDTHLD (SEQ ID NO: 1806) | STYLNWY (SEQ ID NO: 1899) | LVIYAVTSRA (SEQ ID NO: 1992) | QQSYNSPL (SEQ ID NO: 2085) |
| 370_F01 | SSYGMN (SEQ ID NO: 1621) | WVSNINYNGGYTS (SEQ ID NO: 1714) | ARGATWHDTHLD (SEQ ID NO: 1807) | VSYLNWY (SEQ ID NO: 1900) | LLIYAATSRA (SEQ ID NO: 1993) | QQSYDSPL (SEQ ID NO: 2086) |
| 370_F02 | DSYGMN (SEQ ID NO: 1622) | WVANINYNGGYTG (SEQ ID NO: 1715) | ARGATWHDTHLD (SEQ ID NO: 1808) | LSYLNWY (SEQ ID NO: 1901) | LLIYAVTSRH (SEQ ID NO: 1994) | QQSYDSPL (SEQ ID NO: 2087) |
| 370_F12 | SDYSMN (SEQ ID NO: 1623) | WVANINYNGGYTG (SEQ ID NO: 1716) | ARGATWHDTHLD (SEQ ID NO: 1809) | LSYLNWY (SEQ ID NO: 1902) | LLIYAASSLQ (SEQ ID NO: 1995) | QQSYDSPL (SEQ ID NO: 2088) |
| 370_G08 | SDYSMN (SEQ ID NO: 1624) | WVAGINYNGGYTG (SEQ ID NO: 1717) | ARGATWHDTHLD (SEQ ID NO: 1810) | LTYLNWY (SEQ ID NO: 1903) | LVIYAATSRA (SEQ ID NO: 1996) | QQSYESPL (SEQ ID NO: 2089) |
| 370_H04 | SSYSMN (SEQ ID NO: 1625) | WVSNINYNGGYTG (SEQ ID NO: 1718) | ARGATWHDTHLD (SEQ ID NO: 1811) | LSYVNWY (SEQ ID NO: 1904) | LLIYAATSRA (SEQ ID NO: 1997) | QQSYDLPL (SEQ ID NO: 2090) |
| 370_H06 | DDYSMN (SEQ ID NO: 1626) | WVANINYNGGYTG (SEQ ID NO: 1719) | ARGATWHDTHLD (SEQ ID NO: 1812) | LTYLNWY (SEQ ID NO: 1905) | LLIYAATSRA (SEQ ID NO: 1998) | QQSYETPL (SEQ ID NO: 2091) |
| 371_B01 | DSYSMN (SEQ ID NO: 1627) | WVSNINYNSGYTG (SEQ ID NO: 1720) | ARGATWHDTHLD (SEQ ID NO: 1813) | LSYVNWY (SEQ ID NO: 1906) | LLIYAATSLA (SEQ ID NO: 1999) | QQSYDLPL (SEQ ID NO: 2092) |
| 371_C06 | SSYSMN (SEQ ID NO: 1628) | WVSSINYNGGYTS (SEQ ID NO: 1721) | ARGATWHDTHLD (SEQ ID NO: 1814) | SSYLNWY (SEQ ID NO: 1907) | LLIYAVTSRA (SEQ ID NO: 2000) | QQSYDLPL (SEQ ID NO: 2093) |
| 371_C07 | DSYGMN (SEQ ID NO: 1629) | WVSNINYNGGYTG (SEQ ID NO: 1722) | ARGATWHDTALD (SEQ ID NO: 1815) | LSYLNWY (SEQ ID NO: 1908) | LLIYAATSLA (SEQ ID NO: 2001) | QQSYDTPL (SEQ ID NO: 2094) |
| 371_E05 | SSYSMN (SEQ ID NO: 1630) | WVAGINYNGGYTS (SEQ ID NO: 1723) | ARGATWHDTHLD (SEQ ID NO: 1816) | ISYLNWY (SEQ ID NO: 1909) | LVIYAATSRA (SEQ ID NO: 2002) | QQSYSSPL (SEQ ID NO: 2095) |
| 371_E08 | SSYSMN (SEQ ID NO: 1631) | WVSNINYNSGYKS (SEQ ID NO: 1724) | ARGATWHDTHLD (SEQ ID NO: 1817) | VSYVNWY (SEQ ID NO: 1910) | LVIYAATSRH (SEQ ID NO: 2003) | QQSYDLPL (SEQ ID NO: 2096) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 371_E09 | SDYSMN (SEQ ID NO: 1632) | WVSGINYNSGYTS (SEQ ID NO: 1725) | ARGATWHDTHLD (SEQ ID NO: 1818) | LTYLNWY (SEQ ID NO: 1911) | LLIYAATSRA (SEQ ID NO: 2004) | QQSYNSPL (SEQ ID NO: 2097) |
| 371_E12 | DSYSMN (SEQ ID NO: 1633) | WVSGINYNSGYKS (SEQ ID NO: 1726) | ARGATWHDTHLD (SEQ ID NO: 1819) | LSYLNWY (SEQ ID NO: 1912) | LLIYAATSLA (SEQ ID NO: 2005) | QQSYDTPL (SEQ ID NO: 2098) |
| 371_F03 | SSYSMN (SEQ ID NO: 1634) | WVSGINYNGGYTS (SEQ ID NO: 1727) | ARGATWHDTHLD (SEQ ID NO: 1820) | ITYLNWY (SEQ ID NO: 1913) | LLIYAATSLH (SEQ ID NO: 2006) | QQSYDNPL (SEQ ID NO: 2099) |
| 371_F09 | SSYSMN (SEQ ID NO: 1635) | WVAGINYNGGYTS (SEQ ID NO: 1728) | ARGATWHDTHLD (SEQ ID NO: 1821) | LTYLNWY (SEQ ID NO: 1914) | LLIYAATSRA (SEQ ID NO: 2007) | QQSYDNPL (SEQ ID NO: 2100) |
| 371_G01 | SDYSMN (SEQ ID NO: 1636) | WVSNINYNGGYTS (SEQ ID NO: 1729) | ARGATWHDTHLD (SEQ ID NO: 1822) | LTYLNWY (SEQ ID NO: 1915) | LLIYAATSLA (SEQ ID NO: 2008) | QQSYDLPL (SEQ ID NO: 2101) |
| 371_H11 | SSYSMN (SEQ ID NO: 1637) | WVSGINYNGGYKG (SEQ ID NO: 1730) | ARGATWHDTHLD (SEQ ID NO: 1823) | LTYLNWY (SEQ ID NO: 1916) | LLIYATTSRH (SEQ ID NO: 2009) | QQSYESPL (SEQ ID NO: 2102) |
| 372_B09 | SSYSMN (SEQ ID NO: 1638) | WVSSINYNSGYTS (SEQ ID NO: 1731) | ARGATWHDTHLD (SEQ ID NO: 1824) | LTYLNWY (SEQ ID NO: 1917) | LLIYAATSRA (SEQ ID NO: 2010) | QQSYETPL (SEQ ID NO: 2103) |
| 372_E08 | SDYSMN (SEQ ID NO: 1639) | WVSNINYNGGYTS (SEQ ID NO: 1732) | ARGATWHDTHLD (SEQ ID NO: 1825) | ITYLNWY (SEQ ID NO: 1918) | LLIYAATSRA (SEQ ID NO: 2011) | QQSYNLPL (SEQ ID NO: 2104) |
| 372_F02 | SSYGMH (SEQ ID NO: 1640) | WVASINYNGGYTS (SEQ ID NO: 1733) | ARGATWHDTHLD (SEQ ID NO: 1826) | LTYLNWY (SEQ ID NO: 1919) | LVIYAATSRH (SEQ ID NO: 2012) | QQSYDLPL (SEQ ID NO: 2105) |
| 372_H11 | SSYGMH (SEQ ID NO: 1641) | WVAGINYNGGYTS (SEQ ID NO: 1734) | ARGATWHDTHLD (SEQ ID NO: 1827) | LSYVNWY (SEQ ID NO: 1920) | LLIYAATSRA (SEQ ID NO: 2013) | QQSYENPL (SEQ ID NO: 2106) |
| 373_A06 | SSYSMN (SEQ ID NO: 1642) | WVSGINYNGGYKS (SEQ ID NO: 1735) | ARGATWHDTHLD (SEQ ID NO: 1828) | VTYLNWY (SEQ ID NO: 1921) | LLIYAASSLQ (SEQ ID NO: 2014) | QQSYSTPL (SEQ ID NO: 2107) |
| 373_B09 | DSYSMN (SEQ ID NO: 1643) | WVSGINYNGGYKS (SEQ ID NO: 1736) | ARGATWHDTHLD (SEQ ID NO: 1829) | LSYLNWY (SEQ ID NO: 1922) | LVIYAATSLA (SEQ ID NO: 2015) | QQSYETPL (SEQ ID NO: 2108) |
| 373_D06 | SSYSMN (SEQ ID NO: 1644) | WVAGINYNGGYTS (SEQ ID NO: 1737) | ARGATWHDTHLD (SEQ ID NO: 1830) | VTYLNWY (SEQ ID NO: 1923) | LLIYAATSRA (SEQ ID NO: 2016) | QQSYDTPL (SEQ ID NO: 2109) |
| 373_F07 | SSYSMN (SEQ ID NO: 1645) | WVSGINYNSGYKS (SEQ ID NO: 1738) | ARGATWHDTHLD (SEQ ID NO: 1831) | LSYLNWY (SEQ ID NO: 1924) | LLIYAATSLA (SEQ ID NO: 2017) | QQSYETPL (SEQ ID NO: 2110) |
| 373_G02 | SSYSMN (SEQ ID NO: 1646) | WVSGINYNGGYTS (SEQ ID NO: 1739) | ARGATWHDTHLD (SEQ ID NO: 1832) | ITYLNWY (SEQ ID NO: 1925) | LLIYAATSRA (SEQ ID NO: 2018) | QQSYSSPL (SEQ ID NO: 2111) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 374_A04 | SSYSMN (SEQ ID NO: 1647) | WVAGINYNGGYTS (SEQ ID NO: 1740) | ARGATWHDTHLD (SEQ ID NO: 1833) | LTYLNWY (SEQ ID NO: 1926) | LVIYAATSRA (SEQ ID NO: 2019) | QQSYDTPL (SEQ ID NO: 2112) |
| 374_A05 | SDYGMN (SEQ ID NO: 1648) | WVANINYNGGYKG (SEQ ID NO: 1741) | ARGATWHDTHLD (SEQ ID NO: 1834) | VRYLNWY (SEQ ID NO: 1927) | LVIYAATSLA (SEQ ID NO: 2020) | QQSYELPL (SEQ ID NO: 2113) |
| 374_C10 | SSYSMN (SEQ ID NO: 1649) | WVSSINYNGGYKG (SEQ ID NO: 1742) | ARGATWHDTHLD (SEQ ID NO: 1835) | VTYLNWY (SEQ ID NO: 1928) | LLIYAATSLA (SEQ ID NO: 2021) | QQSYNTPL (SEQ ID NO: 2114) |
| 374_D04 | SSYSMN (SEQ ID NO: 1650) | WVAGINYNGGYTS (SEQ ID NO: 1743) | ARGATWHDTHLD (SEQ ID NO: 1836) | LSYLNWY (SEQ ID NO: 1929) | LVIYAATSRH (SEQ ID NO: 2022) | QQSYDTPL (SEQ ID NO: 2115) |
| 374_D09 | DSYGMN (SEQ ID NO: 1651) | WVANINYNGGYKG (SEQ ID NO: 1744) | ARGATWHDTHLD (SEQ ID NO: 1837) | ISYVNWY (SEQ ID NO: 1930) | LLIYAATSLA (SEQ ID NO: 2023) | QQSYDTPL (SEQ ID NO: 2116) |
| 374_G05 | SSYSMN (SEQ ID NO: 1652) | WVSNINYNSGYKG (SEQ ID NO: 1745) | ARGATWHDTHLD (SEQ ID NO: 1838) | ISYLNWY (SEQ ID NO: 1931) | LLIYAATSRA (SEQ ID NO: 2024) | QQSYDLPL (SEQ ID NO: 2117) |
| 374_H05 | SSYSMN (SEQ ID NO: 1653) | WVAGINYNGGYTS (SEQ ID NO: 1746) | ARGATWHDTHLD (SEQ ID NO: 1839) | LSYVNWY (SEQ ID NO: 1932) | LVIYAATSRA (SEQ ID NO: 2025) | QQSYDNPL (SEQ ID NO: 2118) |
| 375_A03 | DSYSMN (SEQ ID NO: 1654) | WVAGINYNGGYTS (SEQ ID NO: 1747) | ARGATWHDTHLD (SEQ ID NO: 1840) | LTYLNWY (SEQ ID NO: 1933) | LLIYAATSRH (SEQ ID NO: 2026) | QQSYDNPL (SEQ ID NO: 2119) |
| 375_B03 | SSYSMN (SEQ ID NO: 1655) | WVAGINYNGGYTS (SEQ ID NO: 1748) | ARGATWHDTHLD (SEQ ID NO: 1841) | LTYLNWY (SEQ ID NO: 1934) | LLIYAATSRA (SEQ ID NO: 2027) | QQSYDSPL (SEQ ID NO: 2120) |
| 375_C01 | SSYGMN (SEQ ID NO: 1656) | WVSSINYNGGYKG (SEQ ID NO: 1749) | ARGATWHDTHLD (SEQ ID NO: 1842) | SSYLNWY (SEQ ID NO: 1935) | LLIYAASSLQ (SEQ ID NO: 2028) | QQSYSTPL (SEQ ID NO: 2121) |
| 375_C11 | SSYSMN (SEQ ID NO: 1657) | WVSSINYNGGYTS (SEQ ID NO: 1750) | ARGATWHDTHLD (SEQ ID NO: 1843) | LSYVNWY (SEQ ID NO: 1936) | LLIYAATSRH (SEQ ID NO: 2029) | QQSYDTPL (SEQ ID NO: 2122) |
| 375_F10 | SSYSMN (SEQ ID NO: 1658) | WVSGINYNGGYTG (SEQ ID NO: 1751) | ARGATWHDTHLD (SEQ ID NO: 1844) | LTYLNWY (SEQ ID NO: 1937) | LVIYAATSRA (SEQ ID NO: 2030) | QQSYDTPL (SEQ ID NO: 2123) |
| 375_H08 | SSYSMN (SEQ ID NO: 1659) | WVSGINYNGGYTS (SEQ ID NO: 1752) | ARGATWHDTHLD (SEQ ID NO: 1845) | LTYLNWY (SEQ ID NO: 1938) | LLIYAATSLA (SEQ ID NO: 2031) | QQSYDSPL (SEQ ID NO: 2124) |
| 376_A02 | SSYSMN (SEQ ID NO: 1660) | WVAGINYNGGYKS (SEQ ID NO: 1753) | ARGATWHDTHLD (SEQ ID NO: 1846) | LSYLNWY (SEQ ID NO: 1939) | LLIYAATSRA (SEQ ID NO: 2032) | QQSYDLPL (SEQ ID NO: 2125) |
| 376_A05 | SSYSMN (SEQ ID NO: 1661) | WVAGINYNSGYKG (SEQ ID NO: 1754) | ARGATWHDTHLD (SEQ ID NO: 1847) | LTYLNWY (SEQ ID NO: 1940) | LLIYAATSRA (SEQ ID NO: 2033) | QQSYNTPL (SEQ ID NO: 2126) |

TABLE 3D-continued

CDR sequences for Group IV antibodies

| Ab | HCDR1 | HCDR2 | HCDR3 | LCDR1 | LCDR2 | LCDR3 |
|---|---|---|---|---|---|---|
| 376_A07 | SSYSMN (SEQ ID NO: 1662) | WVSGINYNGGYKS (SEQ ID NO: 1755) | ARGATWHDTHLD (SEQ ID NO: 1848) | LTYLNWY (SEQ ID NO: 1941) | LLIYAATSRA (SEQ ID NO: 2034) | QQSYDSPL (SEQ ID NO: 2127) |

The consensus sequences for each of these CDRs shown in FIG. 3D are as follows:

HCDR1:
(SEQ ID NO: 6574)
S/DS/DYS/GMN/H

HCDR2:
(SEQ ID NO: 6575)
WVA/SG/N/SINYNG/SGYT/KS/G

HCDR3:
(SEQ ID NO: 6595)
ARGATWHDTH/ALD

LCDR1:
(SEQ ID NO: 6596)
L/I/V/SS/TYL/VNWY

LCDR2:
(SEQ ID NO: 6571)
LL/VIYAA/V/TT/SSR/LA/H/Q

LCDR3:
(SEQ ID NO: 6577)
QQSY/DD/E/S/NT/S/N/LPL

TABLE 2E

Group V Antibody Sequences

| Ab | VH sequence | VL sequence |
|---|---|---|
| 365_A03 | EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCARSANWHDTALDYWGQGTLVTVSS (SEQ ID NO: 2128) | DIQMTQSPSSLSASVGDRVTITCRASQSILSYLNWYQQKPGKAPKLVIYAVTSRASGVPSRFSGSGSGTDFTLTISSLQPEDFATYYCQQSYDSPLTFGGGTKVEIK (SEQ ID NO: 2376) |
| 365_A11 | EVQLLESGGGLVQPGGSLRLSCAASGFTFDDYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2129) | DIQMTQSPSSLSASVGDRVTITCRASQSILSYLNWYQQKPGKAPKLVIYAATSLASGVPSRFSGSGSGTDFTLTISSLQPEDFATYYCQQSYESPLTFGGGTKVEIK (SEQ ID NO: 2377) |
| 365_A12 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCAKSANWHDTHLDYWGQGTLVTVSS (SEQ ID NO: 2130) | DIQMTQSPSSLSASVGDRVTITCRASQSILTYVNWYQQKPGKAPKLLIYAATSRHSGVPSRFSGSGSGTDFTLTISSLQPEDFATYYCQQSYENPLTFGGGTKVEIK (SEQ ID NO: 2378) |
| 365_B01 | EVQLLESGGGLVQPGGSLRLSCAASGFTFDSYGMHWVRQAPGKGLEWVASINYNSGYTSYADSVKGRFTISRDNSKNTLYLQMNSLRAEDTAVYYCARSANWHDTALDYWGQGTLVTVSS (SEQ ID NO: 2131) | DIQMTQSPSSLSASVGDRVTITCRASQSISSYVNWYQQKPGKAPKLVIYAATSRASGVPSRFSGSGSGTDFTLTISSLQPEDFATYYCQQSYESPLTFGGGTKVEIK (SEQ ID NO: 2379) |
| 365_B06 | EVQLLESGGGLVQPGGSLRLSCAASGFTFDSYGMHWVRQAPGKGLEWVSNINYNSGYKSYADSVKGRFTISRDNSKNTLYLQMNSLRAEDTAVYYCARSANWHDTALDYWGQGTLVTVSS (SEQ ID NO: 2132) | DIQMTQSPSSLSASVGDRVTITCRASQSILTYVNWYQQKPGKAPKLLIYAATSLASGVPSRFSGSGSGTDFTLTISSLQPEDFATYYCQQSYDLPLTFGGGTKVEIK (SEQ ID NO: 2380) |
| 365_B07 | EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARSANWHDTALDYWGQGTLVTVSS (SEQ ID NO: 2133) | DIQMTQSPSSLSASVGDRVTITCRASQSILTYLNWYQQKPGKAPKLLIYAATSRASGVPSRFSGSGSGTDFTLTISSLQPEDFATYYCQQSYENPLTFGGGTKVEIK (SEQ ID NO: 2381) |
| 365_B11 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2134) | DIQMTQSPSSLSASVGDRVTITCRASQSIISYLNWYQQKPGKAPKLVIYATTSRHSGVPSRFSGSGSGTDFTLTISSLQPEDFATYYCQQSYDSPLTFGGGTKVEIK (SEQ ID NO: 2382) |

TABLE 2E-continued

| Group V Antibody Sequences | | |
|---|---|---|
| Ab | VH sequence | VL sequence |
| 365_C01 | EVQLLESGGGLVQPGGSLRLSCAASGFTFDSYGMNWVRQAPGKGLEWVSSINYNSGYKSYADSVKGRFTISRDNSKNTLYLQMNSLRAEDTAVYYCARSANWHDTHLDYWGQGTLVTVSS (SEQ ID NO: 2135) | DIQMTQSPSSLSASVGDRVTITCRASQSIVSYLNWYQQKPGKAPKLVIYAVTSRASGVPSRFSGSGSGTDFTLTISSLQPEDFATYYCQQSYESPLTFGGGTKVEIK (SEQ ID NO: 2383) |
| 365_C10 | EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARSANWHDTALDYWGQGTLVTVSS (SEQ ID NO: 2136) | DIQMTQSPSSLSASVGDRVTITCRASQSILSYVNWYQQKPGKAPKLLIYAATSLASGVPSRFSGSGSGTDFTLTISSLQPEDFATYYCQQSYESPLTFGGGTKVEIK (SEQ ID NO: 2384) |
| 365_C11 | EVQLLESGGGLVQPGGSLRLSCAASGFTFSSYSMNWVRQAPGKGLEWVAGINYNGGYKSYADSVKGRFTISRDNSKNTLYLQMNSLRAEDTAVYYCARSANWHDTHLDYWGQGTLVTVSS (SEQ ID NO: 2137) | DIQMTQSPSSLSASVGDRVTITCRASQSIITYLNWYQQKPGKAPKLVIYAVTSRASGVPSRFSGSGSGTDFTLTISSLQPEDFATYYCQQSYSLPLTFGGGTKVEIK (SEQ ID NO: 2385) |
| 365_C12 | EVQLLESGGGLVQPGGSLRLSCAASGFTFSSYGMNWVRQAPGKGLEWVAGINYNSGYKSYADSVKGRFTISRDNSKNTLYLQMNSLRAEDTAVYYCARSANWHDTALDYWGQGTLVTVSS (SEQ ID NO: 2138) | DIQMTQSPSSLSASVGDRVTITCRASQSIVSYVNWYQQKPGKAPKLVIYAVTSLASGVPSRFSGSGSGTDFTLTISSLQPEDFATYYCQQSYDTPLTFGGGTKVEIK (SEQ ID NO: 2386) |
| 365_D09 | EVQLLESGGGLVQPGGSLRLSCAASGFTFSSYGMHWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2139) | DIQMTQSPSSLSASVGDRVTITCRASQSILSYLNWYQQKPGKAPKLLIYAATSRASGVPSRFSGSGSGTDFTLTISSLQPEDFATYYCQQSDESPLTFGGGTKVEIK (SEQ ID NO: 2387) |
| 365_D11 | EVQLLESGGGLVQPGGSLRLSCAASGFTFDSYGMNWVRQAPGKGLEWVSNINYNSGYTSYADSVKGRFTISRDNSKNTLYLQMNSLRAEDTAVYYCARSANWHDTALDYWGQGTLVTVSS (SEQ ID NO: 2140) | DIQMTQSPSSLSASVGDRVTITCRASQSIVSYLNWYQQKPGKAPKLVIYAATSRASGVPSRFSGSGSGTDFTLTISSLQPEDFATYYCQQSYSSPLTFGGGTKVEIK (SEQ ID NO: 2388) |
| 365_D12 | EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSANWHDTALDYWGQGTLVTVSS (SEQ ID NO: 2141) | DIQMTQSPSSLSASVGDRVTITCRASQSIVTYLNWYQQKPGKAPKLVIYAATSRASGVPSRFSGSGSGTDFTLTISSLQPEDFATYYCQQSYDTPLTFGGGTKVEIK (SEQ ID NO: 2389) |
| 365_E01 | EVQLLESGGGLVQPGGSLRLSCAASGFTFSDYSMNWVRQAPGKGLEWVSGINYNSGYKGYADSVKGRFTISRDNSKNTLYLQMNSLRAEDTAVYYCARSANWHDTALDYWGQGTLVTVSS (SEQ ID NO: 2142) | DIQMTQSPSSLSASVGDRVTITCRASQSIISYLNWYQQKPGKAPKLLIYAATSRASGVPSRFSGSGSGTDFTLTISSLQPEDFATYYCQQSYDSPLTFGGGTKVEIK (SEQ ID NO: 2390) |
| 365_E05 | EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2143) | DIQMTQSPSSLSASVGDRVTITCRASQSIVSYVNWYQQKPGKAPKLLIYAATSLASGVPSRFSGSGSGTDFTLTISSLQPEDFATYYCQQSYDNPLTFGGGTKVEIK (SEQ ID NO: 2391) |
| 365_E07 | EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCAKSANWHDTHLDYWGQGTLVTVSS (SEQ ID NO: 2144) | DIQMTQSPSSLSASVGDRVTITCRASQSILSYLNWYQQKPGKAPKLLIYAATSRASGVPSRFSGSGSGTDFTLTISSLQPEDFATYYCQQSYDNPLTFGGGTKVEIK (SEQ ID NO: 2392) |
| 365_E09 | EVQLLESGGGLVQPGGSLRLSCAASGFTFSSYGMHWVRQAPGKGLEWVASINYNSGYKSYADSVKGRFTISRDNSKNTLYLQMNSLRAEDTAVYYCARSANWHDTALDYWGQGTLVTVSS (SEQ ID NO: 2145) | DIQMTQSPSSLSASVGDRVTITCRASQSILTYVNWYQQKPGKAPKLVIYAATSRASGVPSRFSGSGSGTDFTLTISSLQPEDFATYYCQQSDDSPLTFGGGTKVEIK (SEQ ID NO: 2393) |
| 365_F01 | EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSANWHDTHLDYWGQGTLVTVSS (SEQ ID NO: 2146) | DIQMTQSPSSLSASVGDRVTITCRASQSIVSYLNWYQQKPGKAPKLVIYAATSLASGVPSRFSGSGSGTDFTLTISSLQPEDFATYYCQQSYELPLTFGGGTKVEIK (SEQ ID NO: 2394) |

TABLE 2E-continued

Group V Antibody Sequences

| Ab | VH sequence | VL sequence |
|---|---|---|
| 365_F06 | EVQLLESGGGLVQPGGSLRLSCAASGFTFSSYGMNWVRQAPGKGLEWVAGINYNSGYKSYADSVKGRFTISRDNSKNTLYLQMNSLRAEDTAVYYCARSANWHDTALDYWGQGTLVTVSS (SEQ ID NO: 2147) | DIQMTQSPSSLSASVGDRVTITCRASQSILSYVNWYQQKPGKAPKLLIYAATSRASGVPSRFSGSGSGTDFTLTISSLQPEDFATYYCQQSDNLPLTFGGGTKVEIK (SEQ ID NO: 2395) |
| 365_F12 | EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARSANWHDTHLDYWGQGTLVTVSS (SEQ ID NO: 2148) | DIQMTQSPSSLSASVGDRVTITCRASQSILTYVNWYQQKPGKAPKLVIYAATSRHSGVPSRFSGSGSGTDFTLTISSLQPEDFATYYCQQSYETPLTFGGGTKVEIK (SEQ ID NO: 2396) |
| 365_G01 | EVQLLESGGGLVQPGGSLRLSCAASGFTFDSYGMNWVRQAPGKGLEWVAGINYNSGYKSYADSVKGRFTISRDNSKNTLYLQMNSLRAEDTAVYYCARSANWHDTALDYWGQGTLVTVSS (SEQ ID NO: 2149) | DIQMTQSPSSLSASVGDRVTITCRASQSILTYVNWYQQKPGKAPKLLIYATTSRASGVPSRFSGSGSGTDFTLTISSLQPEDFATYYCQQSYDSPLTFGGGTKVEIK (SEQ ID NO: 2397) |
| 365_G11 | EVQLLESGGGLVQPGGSLRLSCAASGFTFSSYGMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2150) | DIQMTQSPSSLSASVGDRVTITCRASQSIITYVNWYQQKPGKAPKLLIYAVTSRHSGVPSRFSGSGSGTDFTLTISSLQPEDFATYYCQQSYNSPLTFGGGTKVEIK (SEQ ID NO: 2398) |
| 365_H02 | EVQLLESGGGLVQPGGSLRLSCAASGFTFSDYGMNWVRQAPGKGLEWVSSINYNGGYTGYADSVKGRFTISRDNSKNTLYLQMNSLRAEDTAVYYCARSANWHDTHLDYWGQGTLVTVSS (SEQ ID NO: 2151) | DIQMTQSPSSLSASVGDRVTITCRASQSILTYLNWYQQKPGKAPKLLIYAATSRASGVPSRFSGSGSGTDFTLTISSLQPEDFATYYCQQSYENPLTFGGGTKVEIK (SEQ ID NO: 2399) |
| 365_H03 | EVQLLESGGGLVQPGGSLRLSCAASGFTFDDYGMNWVRQAPGKGLEWVAGINYNGGYKSYADSVKGRFTISRDNSKNTLYLQMNSLRAEDTAVYYCARSANWHDTALDYWGQGTLVTVSS (SEQ ID NO: 2152) | DIQMTQSPSSLSASVGDRVTITCRASQSILSYVNWYQQKPGKAPKLVIYAATSLHSGVPSRFSGSGSGTDFTLTISSLQPEDFATYYCQQSYNNPLTFGGGTKVEIK (SEQ ID NO: 2400) |
| 365_H06 | EVQLLESGGGLVQPGGSLRLSCAASGFTFSSYGMNWVRQAPGKGLEWVSGINYNSGYTGYADSVKGRFTISRDNSKNTLYLQMNSLRAEDTAVYYCARSANWHDTALDYWGQGTLVTVSS (SEQ ID NO: 2153) | DIQMTQSPSSLSASVGDRVTITCRASQSISSYVNWYQQKPGKAPKLLIYAATSRASGVPSRFSGSGSGTDFTLTISSLQPEDFATYYCQQSYSTPLTFGGGTKVEIK (SEQ ID NO: 2401) |
| 365_H10 | EVQLLESGGGLVQPGGSLRLSCAASGFTFDSYGMNWVRQAPGKGLEWVAGINYNSGYKSYADSVKGRFTISRDNSKNTLYLQMNSLRAEDTAVYYCARSANWHDTHLDYWGQGTLVTVSS (SEQ ID NO: 2154) | DIQMTQSPSSLSASVGDRVTITCRASQSIVTYVNWYQQKPGKAPKLVIYAATSLASGVPSRFSGSGSGTDFTLTISSLQPEDFATYYCQQSYNTPLTFGGGTKVEIK (SEQ ID NO: 2402) |
| 365_H11 | EVQLLESGGGLVQPGGSLRLSCAASGFTFSSYSMNWVRQAPGKGLEWVSGINYNSGYTGYADSVKGRFTISRDNSKNTLYLQMNSLRAEDTAVYYCARSANWHDTALDYWGQGTLVTVSS (SEQ ID NO: 2155) | DIQMTQSPSSLSASVGDRVTITCRASQSILTYLNWYQQKPGKAPKLLIYAATSRASGVPSRFSGSGSGTDFTLTISSLQPEDFATYYCQQSYDSPLTFGGGTKVEIK (SEQ ID NO: 2403) |
| 365_H12 | EVQLLESGGGLVQPGGSLRLSCAASGFTFSSYSMNWVRQAPGKGLEWVSNINYNGGYKSYADSVKGRFTISRDNSKNTLYLQMNSLRAEDTAVYYCARSANWHDTHLDYWGQGTLVTVSS (SEQ ID NO: 2156) | DIQMTQSPSSLSASVGDRVTITCRASQSIITYVNWYQQKPGKAPKLLIYAATSRASGVPSRFSGSGSGTDFTLTISSLQPEDFATYYCQQSYSTPLTFGGGTKVEIK (SEQ ID NO: 2404) |
| 366_A07 | EVQLLESGGGLVQPGGSLRLSCAASGFTFSSYGMHWVRQAPGKGLEWVASINYNGGYTGYADSVKGRFTISRDNSKNTLYLQMNSLRAEDTAVYYCARSANWHDTALDYWGQGTLVTVSS (SEQ ID NO: 2157) | DIQMTQSPSSLSASVGDRVTITCRASQSIVSYVNWYQQKPGKAPKLVIYAATSRHSGVPSRFSGSGSGTDFTLTISSLQPEDFATYYCQQSYESPLTFGGGTKVEIK (SEQ ID NO: 2405) |
| 366_B08 | EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARSANWHDTHLDYWGQGTLVTVSS (SEQ ID NO: 2158) | DIQMTQSPSSLSASVGDRVTITCRASQSIVSYLNWYQQKPGKAPKLLIYAATSRHSGVPSRFSGSGSGTDFTLTISSLQPEDFATYYCQQSYDNPLTFGGGTKVEIK (SEQ ID NO: 2406) |

TABLE 2E-continued

Group V Antibody Sequences

| Ab | VH sequence | VL sequence |
|---|---|---|
| 366_B10 | EVQLLESGGGLVQPGGSLRLSCAASGFTFSSYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2159) | DIQMTQSPSSLSASVGDRVTITCRASQSIISYLNWYQQKPGKAPKLLIYAATSRASGVPSRFSGSGSGTDFTLTISSLQPEDFATYYCQQSYDNPLTFGGGTKVEIK (SEQ ID NO: 2407) |
| 366_B12 | EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCARSANWHDTALDYWGQGTLVTVSS (SEQ ID NO: 2160) | DIQMTQSPSSLSASVGDRVTITCRASQSILTYVNWYQQKPGKAPKLLIYAATSRASGVPSRFSGSGSGTDFTLTISSLQPEDFATYYCQQSYDNPLTFGGGTKVEIK (SEQ ID NO: 2408) |
| 366_D04 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2161) | DIQMTQSPSSLSASVGDRVTITCRASQSISSYVNWYQQKPGKAPKLLIYATTSRASGVPSRFSGSGSGTDFTLTISSLQPEDFATYYCQQSYETPLTFGGGTKVEIK (SEQ ID NO: 2409) |
| 366_E10 | EVQLLESGGGLVQPGGSLRLSCAASGFTFDSYGMNWVRQAPGKGLEWVSGINYNGGYKGYADSVKGRFTISRDNSKNTLYLQMNSLRAEDTAVYYCARSANWHDTHLDYWGQGTLVTVSS (SEQ ID NO: 2162) | DIQMTQSPSSLSASVGDRVTITCRASQSILSYVNWYQQKPGKAPKLVIYAATSRHSGVPSRFSGSGSGTDFTLTISSLQPEDFATYYCQQSYSLPLTFGGGTKVEIK (SEQ ID NO: 2410) |
| 366_F04 | EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2163) | DIQMTQSPSSLSASVGDRVTITCRASQSILSYVNWYQQKPGKAPKLVIYATTSRHSGVPSRFSGSGSGTDFTLTISSLQPEDFATYYCQQSYESPLTFGGGTKVEIK (SEQ ID NO: 2411) |
| 366_F05 | EVQLLESGGGLVQPGGSLRLSCAASGFTFSSYSMNWVRQAPGKGLEWVANINYNSGYKSYADSVKGRFTISRDNSKNTLYLQMNSLRAEDTAVYYCARSANWHDTHLDYWGQGTLVTVSS (SEQ ID NO: 2164) | DIQMTQSPSSLSASVGDRVTITCRASQSILTYLNWYQQKPGKAPKLLIYAATSRASGVPSRFSGSGSGTDFTLTISSLQPEDFATYYCQQSDNTPLTFGGGTKVEIK (SEQ ID NO: 2412) |
| 366_F07 | EVQLLESGGGLVQPGGSLRLSCAASGFTFSDYSMNWVRQAPGKGLEWVAGINYNSGYTSYADSVKGRFTISRDNSKNTLYLQMNSLRAEDTAVYYCARSANWHDTHLDYWGQGTLVTVSS (SEQ ID NO: 2165) | DIQMTQSPSSLSASVGDRVTITCRASQSIITYLNWYQQKPGKAPKLLIYAATSRASGVPSRFSGSGSGTDFTLTISSLQPEDFATYYCQQSYETPLTFGGGTKVEIK (SEQ ID NO: 2413) |
| 366_G04 | EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2166) | DIQMTQSPSSLSASVGDRVTITCRASQSIITYLNWYQQKPGKAPKLLIYAATSRASGVPSRFSGSGSGTDFTLTISSLQPEDFATYYCQQSDDTPLTFGGGTKVEIK (SEQ ID NO: 2414) |
| 366_G05 | EVQLLESGGGLVQPGGSLRLSCAASGFTFDSYGMNWVRQAPGKGLEWVSNINYNGGYTSYADSVKGRFTISRDNSKNTLYLQMNSLRAEDTAVYYCARSANWHDTALDYWGQGTLVTVSS (SEQ ID NO: 2167) | DIQMTQSPSSLSASVGDRVTITCRASQSIISYVNWYQQKPGKAPKLVIYAATSRASGVPSRFSGSGSGTDFTLTISSLQPEDFATYYCQQSYENPLTFGGGTKVEIK (SEQ ID NO: 2415) |
| 366_H06 | EVQLLESGGGLVQPGGSLRLSCAASGFTFSSYGMNWVRQAPGKGLEWVSGINYNSGYTGYADSVKGRFTISRDNSKNTLYLQMNSLRAEDTAVYYCARSANWHDTALDYWGQGTLVTVSS (SEQ ID NO: 2168) | DIQMTQSPSSLSASVGDRVTITCRASQSILSYLNWYQQKPGKAPKLLIYATTSRASGVPSRFSGSGSGTDFTLTISSLQPEDFATYYCQQSYDTPLTFGGGTKVEIK (SEQ ID NO: 2416) |
| 366_H07 | EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2169) | DIQMTQSPSSLSASVGDRVTITCRASQSIISYVNWYQQKPGKAPKLVIYAVTSRASGVPSRFSGSGSGTDFTLTISSLQPEDFATYYCQQSYENPLTFGGGTKVEIK (SEQ ID NO: 2417) |
| 366_H08 | EVQLLESGGGLVQPGGSLRLSCAASGFTFSDYGMNWVRQAPGKGLEWVASINYNSGYTSYADSVKGRFTISRDNSKNTLYLQMNSLRAEDTAVYYCARSANWHDTHLDYWGQGTLVTVSS (SEQ ID NO: 2170) | DIQMTQSPSSLSASVGDRVTITCRASQSILSYVNWYQQKPGKAPKLLIYAATSRHSGVPSRFSGSGSGTDFTLTISSLQPEDFATYYCQQSYNNPLTFGGGTKVEIK (SEQ ID NO: 2418) |

TABLE 2E-continued

Group V Antibody Sequences

| Ab | VH sequence | VL sequence |
|---|---|---|
| 366_H09 | EVQLLESGGGLVQPGGSLRLSCAASGFT FDSYGMNWVRQAPGKGLEWVSNINYNSG YKGYADSVKGRFTISRDNSKNTLYLQMN SLRAEDTAVYYCARSANWHDTALDYWGQ GTLVTVSS (SEQ ID NO: 2171) | DIQMTQSPSSLSASVGDRVTITCRASQSIVSYVN WYQQKPGKAPKLVIYATTSRASGVPSRFSGSGSG TDFTLTISSLQPEDFATYYCQQSYSSPLTFGGGT KVEIK (SEQ ID NO: 2419) |
| 367_A04 | EVQLLESGGGLVQPGGSLRLSCAASGFT FSSYSMNWVRQAPGKGLEWVSNINYNSG YKSYADSVKGRFTISRDNSKNTLYLQMN SLRAEDTAVYYCARSANWHDTALDYWGQ GTLVTVSS (SEQ ID NO: 2172) | DIQMTQSPSSLSASVGDRVTITCRASQSIITYLN WYQQKPGKAPKLLIYAATSRASGVPSRFSGSGSG TDFTLTISSLQPEDFATYYCQQSDDSPLTFGGGT KVEIK (SEQ ID NO: 2420) |
| 367_A05 | EVQLLESGGGLVQPGGSLRLSCAASGFT FSDYGMNWVRQAPGKGLEWVSSINYNGG YKGYADSVKGRFTISRDNSKNTLYLQMN SLRAEDTAVYYCARSANWHDTALDYWGQ GTLVTVSS (SEQ ID NO: 2173) | DIQMTQSPSSLSASVGDRVTITCRASQSILSYLN WYQQKPGKAPKLVIYAVTSRASGVPSRFSGSGSG TDFTLTISSLQPEDFATYYCQQSYDSPLTFGGGT KVEIK (SEQ ID NO: 2421) |
| 367_B02 | EVQLLESGGGLVQPGGSLRLSCAASGFT FDSYGMNWVRQAPGKGLEWVSSINYNGG YTSYADSVKGRFTISRDNSKNTLYLQMN SLRAEDTAVYYCARSANWHDTALDYWGQ GTLVTVSS (SEQ ID NO: 2174) | DIQMTQSPSSLSASVGDRVTITCRASQSIVTYLN WYQQKPGKAPKLLIYAASSLQSGVPSRFSGSGSG TDFTLTISSLQPEDFATYYCQQSYSTPLTFGGGT KVEIK (SEQ ID NO: 2422) |
| 367_B03 | EVQLLESGGGLVQPGGSLRLSCAASGFT FSSYGMNWVRQAPGKGLEWVAGINYNGG YKSYADSVKGRFTISRDNSKNTLYLQMN SLRAEDTAVYYCARSANWHDTALDYWGQ GTLVTVSS (SEQ ID NO: 2175) | DIQMTQSPSSLSASVGDRVTITCRASQSILTYLN WYQQKPGKAPKLLIYAATSLASGVPSRFSGSGSG TDFTLTISSLQPEDFATYYCQQSYNLPLTFGGGT KVEIK (SEQ ID NO: 2423) |
| 367_B07 | EVQLLESGGGLVQPGGSLRLSCAASGFT FSDYSMNWVRQAPGKGLEWVAGINYNSG YTGYADSVKGRFTISRDNSKNTLYLQMN SLRAEDTAVYYCARSANWHDTHLDYWGQ GTLVTVSS (SEQ ID NO: 2176) | DIQMTQSPSSLSASVGDRVTITCRASQSIISYVN WYQQKPGKAPKLLIYAATSLASGVPSRFSGSGSG TDFTLTISSLQPEDFATYYCQQSYNLPLTFGGGT KVEIK (SEQ ID NO: 2424) |
| 367_B08 | EVQLLESGGGLVQPGGSLRLSCAASGFT FSDYGMNWVRQAPGKGLEWVSGINYNGG YKGYADSVKGRFTISRDNSKNTLYLQMN SLRAEDTAVYYCARSANWHDTALDYWGQ GTLVTVSS (SEQ ID NO: 2177) | DIQMTQSPSSLSASVGDRVTITCRASQSILTYLN WYQQKPGKAPKLVIYAATSRASGVPSRFSGSGSG TDFTLTISSLQPEDFATYYCQQSYDNPLTFGGGT KVEIK (SEQ ID NO: 2425) |
| 367_C01 | EVQLLESGGGLVQPGGSLRLSCAASGFT FDDYSMNWVRQAPGKGLEWVSGINYNGG YKSYADSVKGRFTISRDNSKNTLYLQMN SLRAEDTAVYYCARSANWHDTHLDYWGQ GTLVTVSS (SEQ ID NO: 2178) | DIQMTQSPSSLSASVGDRVTITCRASQSILTYLN WYQQKPGKAPKLVIYATTSLHSGVPSRFSGSGSG TDFTLTISSLQPEDFATYYCQQSYDTPLTFGGGT KVEIK (SEQ ID NO: 2426) |
| 367_C05 | EVQLLESGGGLVQPGGSLRLSCAASGFT FDDYGMNWVRQAPGKGLEWVSSINYNGG YTGYADSVKGRFTISRDNSKNTLYLQMN SLRAEDTAVYYCARSANWHDTHLDYWGQ GTLVTVSS (SEQ ID NO: 2179) | DIQMTQSPSSLSASVGDRVTITCRASQSILSYVN WYQQKPGKAPKLVIYAATSRHSGVPSRFSGSGSG TDFTLTISSLQPEDFATYYCQQSYDLPLTFGGGT KVEIK (SEQ ID NO: 2427) |
| 367_C11 | EVQLLESGGGLVQPGGSLRLSCAASGFT FDSYSMNWVRQAPGKGLEWVSSINYNSG YTGYADSVKGRFTISRDNSKNTLYLQMN SLRAEDTAVYYCARSANWHDTHLDYWGQ GTLVTVSS (SEQ ID NO: 2180) | DIQMTQSPSSLSASVGDRVTITCRASQSILSYLN WYQQKPGKAPKLVIYAATSRHSGVPSRFSGSGSG TDFTLTISSLQPEDFATYYCQQSYNTPLTFGGGT KVEIK (SEQ ID NO: 2428) |
| 367_D10 | EVQLLESGGGLVQPGGSLRLSCAASGFT FDSYGMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2181) | DIQMTQSPSSLSASVGDRVTITCRASQSIISYLN WYQQKPGKAPKLVIYAATSRASGVPSRFSGSGSG TDFTLTISSLQPEDFATYYCQQSYDTPLTFGGGT KVEIK (SEQ ID NO: 2429) |
| 367_E01 | EVQLLESGGGLVQPGGSLRLSCAASGFT FSSYGMNWVRQAPGKGLEWVAGINYNGG YKSYADSVKGRFTISRDNSKNTLYLQMN SLRAEDTAVYYCARSANWHDTALDYWGQ GTLVTVSS (SEQ ID NO: 2182) | DIQMTQSPSSLSASVGDRVTITCRASQSILSYVN WYQQKPGKAPKLLIYATTSRASGVPSRFSGSGSG TDFTLTISSLQPEDFATYYCQQSYDLPLTFGGGT KVEIK (SEQ ID NO: 2430) |

TABLE 2E-continued

Group V Antibody Sequences

| Ab | VH sequence | VL sequence |
|---|---|---|
| 367_E04 | EVQLLESGGGLVQPGGSLRLSCAASGFTFSDYSMNWVRQAPGKGLEWVSSINYGGYKGYADSVKGRFTISRDNSKNTLYLQMNSLRAEDTAVYYCARSANWHDTHLDYWGQGTLVTVSS (SEQ ID NO: 2183) | DIQMTQSPSSLSASVGDRVTITCRASQSILSYLNWYQQKPGKAPKLLIYAATSRASGVPSRFSGSGSGTDFTLTISSLQPEDFATYYCQQSYESPLTFGGGTKVEIK (SEQ ID NO: 2431) |
| 367_E06 | EVQLLESGGGLVQPGGSLRLSCAASGFTFDSYSMNWVRQAPGKGLEWVSSINYNSGYKGYADSVKGRFTISRDNSKNTLYLQMNSLRAEDTAVYYCARSANWHDTHLDYWGQGTLVTVSS (SEQ ID NO: 2184) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 2432) |
| 367_E09 | EVQLLESGGGLVQPGGSLRLSCAASGFTFSDYGMNWVRQAPGKGLEWVASINYNSGYKGYADSVKGRFTISRDNSKNTLYLQMNSLRAEDTAVYYCARSANWHDTALDYWGQGTLVTVSS (SEQ ID NO: 2185) | DIQMTQSPSSLSASVGDRVTITCRASQSILSYLNWYQQKPGKAPKLVIYATTSRASGVPSRFSGSGSGTDFTLTISSLQPEDFATYYCQQSYETPLTFGGGTKVEIK (SEQ ID NO: 2433) |
| 367_E11 | EVQLLESGGGLVQPGGSLRLSCAASGFTFDSYGMNWVRQAPGKGLEWVSSINYNSGYKGYADSVKGRFTISRDNSKNTLYLQMNSLRAEDTAVYYCARSANWHDTHLDYWGQGTLVTVSS (SEQ ID NO: 2186) | DIQMTQSPSSLSASVGDRVTITCRASQSIVSYVNWYQQKPGKAPKLVIYAATSRHSGVPSRFSGSGSGTDFTLTISSLQPEDFATYYCQQSYDTPLTFGGGTKVEIK (SEQ ID NO: 2434) |
| 367_F03 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSANWHDTALDYWGQGTLVTVSS (SEQ ID NO: 2187) | DIQMTQSPSSLSASVGDRVTITCRASQSILSYVNWYQQKPGKAPKLVIYAATSLASGVPSRFSGSGSGTDFTLTISSLQPEDFATYYCQQSDDTPLTFGGGTKVEIK (SEQ ID NO: 2435) |
| 367_F07 | EVQLLESGGGLVQPGGSLRLSCAASGFTFDSYGMHWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2188) | DIQMTQSPSSLSASVGDRVTITCRASQSIISYVNWYQQKPGKAPKLLIYAATSRASGVPSRFSGSGSGTDFTLTISSLQPEDFATYYCQQSYETPLTFGGGTKVEIK (SEQ ID NO: 2436) |
| 367_F11 | EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARSANWHDTHLDYWGQGTLVTVSS (SEQ ID NO: 2189) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 2437) |
| 367_G05 | EVQLLESGGGLVQPGGSLRLSCAASGFTFSDYGMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2190) | DIQMTQSPSSLSASVGDRVTITCRASQSIVSYLNWYQQKPGKAPKLVIYAATSLASGVPSRFSGSGSGTDFTLTISSLQPEDFATYYCQQSYDTPLTFGGGTKVEIK (SEQ ID NO: 2438) |
| 367_G06 | EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARSANWHDTHLDYWGQGTLVTVSS (SEQ ID NO: 2191) | DIQMTQSPSSLSASVGDRVTITCRASQSILTYVNWYQQKPGKAPKLLIYATTSLHSGVPSRFSGSGSGTDFTLTISSLQPEDFATYYCQQSYDTPLTFGGGTKVEIK (SEQ ID NO: 2439) |
| 367_G10 | EVQLLESGGGLVQPGGSLRLSCAASGFTFDDYGMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2192) | DIQMTQSPSSLSASVGDRVTITCRASQSIISYVNWYQQKPGKAPKLLIYAATSRASGVPSRFSGSGSGTDFTLTISSLQPEDFATYYCQQSYDSPLTFGGGTKVEIK (SEQ ID NO: 2440) |
| 367_H06 | EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARSANWHDTHLDYWGQGTLVTVSS (SEQ ID NO: 2193) | DIQMTQSPSSLSASVGDRVTITCRASQSIITYLNWYQQKPGKAPKLLIYAATSRASGVPSRFSGSGSGTDFTLTISSLQPEDFATYYCQQSYDTPLTFGGGTKVEIK (SEQ ID NO: 2441) |
| 367_H11 | EVQLLESGGGLVQPGGSLRLSCAASGFTFSSYGMNWVRQAPGKGLEWVAGINYNGGYKGYADSVKGRFTISRDNSKNTLYLQMNSLRAEDTAVYYCARSANWHDTALDYWGQGTLVTVSS (SEQ ID NO: 2194) | DIQMTQSPSSLSASVGDRVTITCRASQSIISYVNWYQQKPGKAPKLVIYAATSRASGVPSRFSGSGSGTDFTLTISSLQPEDFATYYCQQSYNSPLTFGGGTKVEIK (SEQ ID NO: 2442) |

TABLE 2E-continued

Group V Antibody Sequences

| Ab | VH sequence | VL sequence |
|---|---|---|
| 368_A01 | EVQLLESGGGLVQPGGSLRLSCAASGFT FSSYGMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2195) | DIQMTQSPSSLSASVGDRVTITCRASQSIISYLN WYQQKPGKAPKLLIYAATSRHSGVPSRFSGSGSG TDFTLTISSLQPEDFATYYCQQSYDNPLTFGGGT KVEIK (SEQ ID NO: 2443) |
| 368_A05 | EVQLLESGGGLVQPGGSLRLSCAASGFT FSSYSMNWVRQAPGKGLEWVAGINYNSG YTGYADSVKGRFTISRDNSKNTLYLQMN SLRAEDTAVYYCARSANWHDTALDYWGQ GTLVTVSS (SEQ ID NO: 2196) | DIQMTQSPSSLSASVGDRVTITCRASQSIVSYLN WYQQKPGKAPKLVIYAATSRASGVPSRFSGSGSG TDFTLTISSLQPEDFATYYCQQSYDSPLTFGGGT KVEIK (SEQ ID NO: 2444) |
| 368_A07 | EVQLLESGGGLVQPGGSLRLSCAASGFT FSSYSMNWVRQAPGKGLEWVAGINYNSG YTSYADSVKGRFTISRDNSKNTLYLQMN SLRAEDTAVYYCARSANWHDTHLDYWGQ GTLVTVSS (SEQ ID NO: 2197) | DIQMTQSPSSLSASVGDRVTITCRASQSILTYLN WYQQKPGKAPKLVIYATTSRASGVPSRFSGSGSG TDFTLTISSLQPEDFATYYCQQSNELPLTFGGGT KVEIK (SEQ ID NO: 2445) |
| 368_A09 | EVQLLESGGGLVQPGGSLRLSCAASGFT FDSYSMNWVRQAPGKGLEWVSGINYNGG YTSYADSVKGRFTISRDNSKNTLYLQMN SLRAEDTAVYYCARSANWHDTHLDYWGQ GTLVTVSS (SEQ ID NO: 2198) | DIQMTQSPSSLSASVGDRVTITCRASQSILSYVN WYQQKPGKAPKLLIYAVTSRASGVPSRFSGSGSG TDFTLTISSLQPEDFATYYCQQSYDSPLTFGGGT KVEIK (SEQ ID NO: 2446) |
| 368_B01 | EVQLLESGGGLVQPGGSLRLSCAASGFT FSSYGMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2199) | DIQMTQSPSSLSASVGDRVTITCRASQSISSYLN WYQQKPGKAPKLLIYAATSRASGVPSRFSGSGSG TDFTLTISSLQPEDFATYYCQQSYETPLTFGGGT KVEIK (SEQ ID NO: 2447) |
| 368_B06 | EVQLLESGGGLVQPGGSLRLSCAASGFT FDSYGMHWVRQAPGKGLEWVSGINYNSG YTSYADSVKGRFTISRDNSKNTLYLQMN SLRAEDTAVYYCARSANWHDTALDYWGQ GTLVTVSS (SEQ ID NO: 2200) | DIQMTQSPSSLSASVGDRVTITCRASQSIISYLN WYQQKPGKAPKLLIYAASSLQSGVPSRFSGSGSG TDFTLTISSLQPEDFATYYCQQSYSTPLTFGGGT KVEIK (SEQ ID NO: 2448) |
| 368_B07 | EVQLLESGGGLVQPGGSLRLSCAASGFT FSDYSMNWVRQAPGKGLEWVSNINYNGG YKSYADSVKGRFTISRDNSKNTLYLQMN SLRAEDTAVYYCARSANWHDTALDYWGQ GTLVTVSS (SEQ ID NO: 2201) | DIQMTQSPSSLSASVGDRVTITCRASQSIVSYLN WYQQKPGKAPKLLIYAATSLASGVPSRFSGSGSG TDFTLTISSLQPEDFATYYCQQSYSSPLTFGGGT KVEIK (SEQ ID NO: 2449) |
| 368_C05 | EVQLLESGGGLVQPGGSLRLSCAASGFT FDSYGMNWVRQAPGKGLEWVSGINYNSG YTSYADSVKGRFTISRDNSKNTLYLQMN SLRAEDTAVYYCARSANWHDTALDYWGQ GTLVTVSS (SEQ ID NO: 2202) | DIQMTQSPSSLSASVGDRVTITCRASQSILSYLN WYQQKPGKAPKLVIYAATSRASGVPSRFSGSGSG TDFTLTISSLQPEDFATYYCQQSDSNPLTFGGGT KVEIK (SEQ ID NO: 2450) |
| 368_D01 | EVQLLESGGGLVQPGGSLRLSCAASGFT FSSYGMHWVRQAPGKGLEWVANINYNGG YTSYADSVKGRFTISRDNSKNTLYLQMN SLRAEDTAVYYCARSANWHDTALDYWGQ GTLVTVSS (SEQ ID NO: 2203) | DIQMTQSPSSLSASVGDRVTITCRASQSILSYLN WYQQKPGKAPKLVIYAATSRASGVPSRFSGSGSG TDFTLTISSLQPEDFATYYCQQSDSTPLTFGGGT KVEIK (SEQ ID NO: 2451) |
| 368_D04 | EVQLLESGGGLVQPGGSLRLSCAASGFT FSSYGMNWVRQAPGKGLEWVSGINYNGG YKSYADSVKGRFTISRDNSKNTLYLQMN SLRAEDTAVYYCARSANWHDTALDYWGQ GTLVTVSS (SEQ ID NO: 2204) | DIQMTQSPSSLSASVGDRVTITCRASQSISTYVN WYQQKPGKAPKLVIYAVTSRHSGVPSRFSGSGSG TDFTLTISSLQPEDFATYYCQQSYDSPLTFGGGT KVEIK (SEQ ID NO: 2452) |
| 368_D05 | EVQLLESGGGLVQPGGSLRLSCAASGFT FSSYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2205) | DIQMTQSPSSLSASVGDRVTITCRASQSILTYLN WYQQKPGKAPKLVIYAATSRASGVPSRFSGSGSG TDFTLTISSLQPEDFATYYCQQSDDSPLTFGGGT KVEIK (SEQ ID NO: 2453) |
| 368_D11 | EVQLLESGGGLVQPGGSLRLSCAASGFT FDDYGMNWVRQAPGKGLEWVSNINYNGG YKSYADSVKGRFTISRDNSKNTLYLQMN SLRAEDTAVYYCARSANWHDTALDYWGQ GTLVTVSS (SEQ ID NO: 2206) | DIQMTQSPSSLSASVGDRVTITCRASQSILTYLN WYQQKPGKAPKLVIYAATSRASGVPSRFSGSGSG TDFTLTISSLQPEDFATYYCQQSYDLPLTFGGGT KVEIK (SEQ ID NO: 2454) |

TABLE 2E-continued

Group V Antibody Sequences

| Ab | VH sequence | VL sequence |
|---|---|---|
| 368_E01 | EVQLLESGGGLVQPGGSLRLSCAASGFT FSSYSMNWVRQAPGKGLEWVASINYNSG YTGYADSVKGRFTISRDNSKNTLYLQMN SLRAEDTAVYYCARSANWHDTHLDYWGQ GTLVTVSS (SEQ ID NO: 2207) | DIQMTQSPSSLSASVGDRVTITCRASQSILSYLN WYQQKPGKAPKLLIYAVTSRHSGVPSRFSGSGSG TDFTLTISSLQPEDFATYYCQQSYSLPLTFGGGT KVEIK (SEQ ID NO: 2455) |
| 368_E02 | EVQLLESGGGLVQPGGSLRLSCAASGFT FDSYSMNWVRQAPGKGLEWVAGINYNSG YTGYADSVKGRFTISRDNSKNTLYLQMN SLRAEDTAVYYCARSANWHDTHLDYWGQ GTLVTVSS (SEQ ID NO: 2208) | DIQMTQSPSSLSASVGDRVTITCRASQSILTYLN WYQQKPGKAPKLLIYAATSRASGVPSRFSGSGSG TDFTLTISSLQPEDFATYYCQQSYSSPLTFGGGT KVEIK (SEQ ID NO: 2456) |
| 368_E04 | EVQLLESGGGLVQPGGSLRLSCAASGFT FSSYSMNWVRQAPGKGLEWVANINYNSG YTGYADSVKGRFTISRDNSKNTLYLQMN SLRAEDTAVYYCARSANWHDTALDYWGQ GTLVTVSS (SEQ ID NO: 2209) | DIQMTQSPSSLSASVGDRVTITCRASQSILSYVN WYQQKPGKAPKLLIYAATSRHSGVPSRFSGSGSG TDFTLTISSLQPEDFATYYCQQSYDNPLTFGGGT KVEIK (SEQ ID NO: 2457) |
| 368_E06 | EVQLLESGGGLVQPGGSLRLSCAASGFT FSDYGMHWVRQAPGKGLEWVSGINYNGG YTGYADSVKGRFTISRDNSKNTLYLQMN SLRAEDTAVYYCARSANWHDTALDYWGQ GTLVTVSS (SEQ ID NO: 2210) | DIQMTQSPSSLSASVGDRVTITCRASQSILSYLN WYQQKPGKAPKLVIYGATSRASGVPSRFSGSGSG TDFTLTISSLQPEDFATYYCQQSYDSPLTFGGGT KVEIK (SEQ ID NO: 2458) |
| 368_E07 | EVQLLESGGGLVQPGGSLRLSCAASGFT FSSYGMNWVRQAPGKGLEWVAGINYNGG YTGYADSVKGRFTISRDNSKNTLYLQMN SLRAEDTAVYYCAKSANWHDTALDYWGQ GTLVTVSS (SEQ ID NO: 2211) | DIQMTQSPSSLSASVGDRVTITCRASQSILSYLN WYQQKPGKAPKLLIYAVTSRASGVPSRFSGSGSG TDFTLTISSLQPEDFATYYCQQSYENPLTFGGGT KVEIK (SEQ ID NO: 2459) |
| 368_F03 | EVQLLESGGGLVQPGGSLRLSCAASGFT FDSYSMNWVRQAPGKGLEWVAGINYNSG YTGYADSVKGRFTISRDNSKNTLYLQMN SLRAEDTAVYYCAKSANWHDTALDYWGQ GTLVTVSS (SEQ ID NO: 2212) | DIQMTQSPSSLSASVGDRVTITCRASQSIISYLN WYQQKPGKAPKLVIYAATSRHSGVPSRFSGSGSG TDFTLTISSLQPEDFATYYCQQSYDSPLTFGGGT KVEIK (SEQ ID NO: 2460) |
| 368_F11 | EVQLLESGGGLVQPGGSLRLSCAASGFT FSDYGMNWVRQAPGKGLEWVSGINYNGG YTGYADSVKGRFTISRDNSKNTLYLQMN SLRAEDTAVYYCARSANWHDTHLDYWGQ GTLVTVSS (SEQ ID NO: 2213) | DIQMTQSPSSLSASVGDRVTITCRASQSIVSYVN WYQQKPGKAPKLVIYAATSRASGVPSRFSGSGSG TDFTLTISSLQPEDFATYYCQQSYNNPLTFGGGT KVEIK (SEQ ID NO: 2461) |
| 368_G01 | EVQLLESGGGLVQPGGSLRLSCAASGFT FSDYGMHWVRQAPGKGLEWVASINYNSG YTSYADSVKGRFTISRDNSKNTLYLQMN SLRAEDTAVYYCARSANWHDTALDYWGQ GTLVTVSS (SEQ ID NO: 2214) | DIQMTQSPSSLSASVGDRVTITCRASQSILTYLN WYQQKPGKAPKLVIYAATSRASGVPSRFSGSGSG TDFTLTISSLQPEDFATYYCQQSYNLPLTFGGGT KVEIK (SEQ ID NO: 2462) |
| 368_G12 | EVQLLESGGGLVQPGGSLRLSCAASGFT FSSYGMNWVRQAPGKGLEWVASINYNSG YTGYADSVKGRFTISRDNSKNTLYLQMN SLRAEDTAVYYCARSANWHDTALDYWGQ GTLVTVSS (SEQ ID NO: 2215) | DIQMTQSPSSLSASVGDRVTITCRASQSISSYVN WYQQKPGKAPKLVIYAVTSRASGVPSRFSGSGSG TDFTLTISSLQPEDFATYYCQQSYETPLTFGGGT KVEIK (SEQ ID NO: 2463) |
| 368_H04 | EVQLLESGGGLVQPGGSLRLSCAASGFT FSSYSMNWVRQAPGKGLEWVAGINYNSG YKGYADSVKGRFTISRDNSKNTLYLQMN SLRAEDTAVYYCAKSANWHDTHLDYWGQ GTLVTVSS (SEQ ID NO: 2216) | DIQMTQSPSSLSASVGDRVTITCRASQSIVSYVN WYQQKPGKAPKLLIYAATSRASGVPSRFSGSGSG TDFTLTISSLQPEDFATYYCQQSYDSPLTFGGGT KVEIK (SEQ ID NO: 2464) |
| 369_A02 | EVQLLESGGGLVQPGGSLRLSCAASGFT FSSYSMNWVRQAPGKGLEWVAGINYNSG YTGYADSVKGRFTISRDNSKNTLYLQMN SLRAEDTAVYYCARSANWHDTHLDYWGQ GTLVTVSS (SEQ ID NO: 2217) | DIQMTQSPSSLSASVGDRVTITCRASQSILSYVN WYQQKPGKAPKLLIYAATSRASGVPSRFSGSGSG TDFTLTISSLQPEDFATYYCQQSYDLPLTFGGGT KVEIK (SEQ ID NO: 2465) |
| 369_A03 | EVQLLESGGGLVQPGGSLRLSCAASGFT FSSYGMNWVRQAPGKGLEWVSNINYNGG YTGYADSVKGRFTISRDNSKNTLYLQMN SLRAEDTAVYYCARSANWHDTALDYWGQ GTLVTVSS (SEQ ID NO: 2218) | DIQMTQSPSSLSASVGDRVTITCRASQSILTYLN WYQQKPGKAPKLLIYAVTSRHSGVPSRFSGSGSG TDFTLTISSLQPEDFATYYCQQGYDLPLTFGGGT KVEIK (SEQ ID NO: 2466) |

TABLE 2E-continued

Group V Antibody Sequences

| Ab | VH sequence | VL sequence |
|---|---|---|
| 369_B01 | EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2219) | DIQMTQSPSSLSASVGDRVTITCRASQSILSYLNWYQQKPGKAPKLLIYAVTSRASGVPSRFSGSGSGTDFTLTISSLQPEDFATYYCQQSYENPLTFGGGTKVEIK (SEQ ID NO: 2467) |
| 369_C02 | EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARSANWHDTALDYWGQGTLVTVSS (SEQ ID NO: 2220) | DIQMTQSPSSLSASVGDRVTITCRASQSILTYLNWYQQKPGKAPKLVIYAATSRASGVPSRFSGSGSGTDFTLTISSLQPEDFATYYCQQSYELPLTFGGGTKVEIK (SEQ ID NO: 2468) |
| 369_C03 | EVQLLESGGGLVQPGGSLRLSCAASGFTFSSYGMNWVRQAPGKGLEWVSNINYNGGYKSYADSVKGRFTISRDNSKNTLYLQMNSLRAEDTAVYYCARSANWHDTALDYWGQGTLVTVSS (SEQ ID NO: 2221) | DIQMTQSPSSLSASVGDRVTITCRASQSILTYLNWYQQKPGKAPKLVIYAATSRASGVPSRFSGSGSGTDFTLTISSLQPEDFATYYCQQSYDSPLTFGGGTKVEIK (SEQ ID NO: 2469) |
| 369_C04 | EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARSANWHDTALDYWGQGTLVTVSS (SEQ ID NO: 2222) | DIQMTQSPSSLSASVGDRVTITCRASQSILTYVNWYQQKPGKAPKLLIYTTTSLHSGVPSRFSGSGSGTDFTLTISSLQPEDFATYYCQQSYNNPLTFGGGTKVEIK (SEQ ID NO: 2470) |
| 369_D01 | EVQLLESGGGLVQPGGSLRLSCAASGFTFSDYGMNWVRQAPGKGLEWVASINYNGGYTGYADSVKGRFTISRDNSKNTLYLQMNSLRAEDTAVYYCARSANWHDTALDYWGQGTLVTVSS (SEQ ID NO: 2223) | DIQMTQSPSSLSASVGDRVTITCRASQSILTYLNWYQQKPGKAPKLLIYAATSRASGVPSRFSGSGSGTDFTLTISSLQPEDFATYYCQQSYSNPLTFGGGTKVEIK (SEQ ID NO: 2471) |
| 369_D02 | EVQLLESGGGLVQPGGSLRLSCAASGFTFSDYSMNWVRQAPGKGLEWVSNINYNSGYTGYADSVKGRFTISRDNSKNTLYLQMNSLRAEDTAVYYCARSANWHDTALDYWGQGTLVTVSS (SEQ ID NO: 2224) | DIQMTQSPSSLSASVGDRVTITCRASQSILSYLNWYQQKPGKAPKLVIYAVTSRASGVPSRFSGSGSGTDFTLTISSLQPEDFATYYCQQSYDTPLTFGGGTKVEIK (SEQ ID NO: 2472) |
| 369_D04 | EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2225) | DIQMTQSPSSLSASVGDRVTITCRASQSILSYVNWYQQKPGKAPKLVIYAATSRASGVPSRFSGSGSGTDFTLTISSLQPEDFATYYCQQSYNLPLTFGGGTKVEIK (SEQ ID NO: 2473) |
| 369_D12 | EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSANWHDTALDYWGQGTLVTVSS (SEQ ID NO: 2226) | DIQMTQSPSSLSASVGDRVTITCRASQSILSYLNWYQQKPGKAPKLLIYAATSLASGVPSRFSGSGSGTDFTLTISSLQPEDFATYYCQQSYDTPLTFGGGTKVEIK (SEQ ID NO: 2474) |
| 369_E02 | EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSANWHDTALDYWGQGTLVTVSS (SEQ ID NO: 2227) | DIQMTQSPSSLSASVGDRVTITCRASQSIVSYVNWYQQKPGKAPKLLIYATTSRHSGVPSRFSGSGSGTDFTLTISSLQPEDFATYYCQQSYDNPLTFGGGTKVEIK (SEQ ID NO: 2475) |
| 369_E11 | EVQLLESGGGLVQPGGSLRLSCAASGFTFSSYGMNWVRQAPGKGLEWVSNINYNGGYTSYADSVKGRFTISRDNSKNTLYLQMNSLRAEDTAVYYCARSANWHDTALDYWGQGTLVTVSS (SEQ ID NO: 2228) | DIQMTQSPSSLSASVGDRVTITCRASQSIISYLNWYQQKPGKAPKLLIYAATSLASGVPSRFSGSGSGTDFTLTISSLQPEDFATYYCQQSYDTPLTFGGGTKVEIK (SEQ ID NO: 2476) |
| 369_E12 | EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARSANWHDTALDYWGQGTLVTVSS (SEQ ID NO: 2229) | DIQMTQSPSSLSASVGDRVTITCRASQSIISYLNWYQQKPGKAPKLLIYAATSRASGVPSRFSGSGSGTDFTLTISSLQPEDFATYYCQQSYESPLTFGGGTKVEIK (SEQ ID NO: 2477) |
| 369_F01 | EVQLLESGGGLVQPGGSLRLSCAASGFTFSSYGMNWVRQAPGKGLEWVSGINYNGGYKSYADSVKGRFTISRDNSKNTLYLQMNSLRAEDTAVYYCARSANWHDTALDYWGQGTLVTVSS (SEQ ID NO: 2230) | DIQMTQSPSSLSASVGDRVTITCRASQSILTYVNWYQQKPGKAPKLLIYAATSRASGVPSRFSGSGSGTDFTLTISSLQPEDFATYYCQQSYELPLTFGGGTKVEIK (SEQ ID NO: 2478) |

TABLE 2E-continued

Group V Antibody Sequences

| Ab | VH sequence | VL sequence |
|---|---|---|
| 369_F02 | EVQLLESGGGLVQPGGSLRLSCAASGFTFSSYGMNWVRQAPGKGLEWVASINYNSGYKSYADSVKGRFTISRDNSKNTLYLQMNSLRAEDTAVYYCARSANWHDTALDYWGQGTLVTVSS (SEQ ID NO: 2231) | DIQMTQSPSSLSASVGDRVTITCRASQSIVSYLNWYQQKPGKAPKLVIYAATSRASGVPSRFSGSGSGTDFTLTISSLQPEDFATYYCQQSYDTPLTFGGGTKVEIK (SEQ ID NO: 2479) |
| 369_F03 | EVQLLESGGGLVQPGGSLRLSCAASGFTFSDYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2232) | DIQMTQSPSSLSASVGDRVTITCRASQSIVSYVNWYQQKPGKAPKLLIYAATSLASGVPSRFSGSGSGTDFTLTISSLQPEDFATYYCQQSYDSPLTFGGGTKVEIK (SEQ ID NO: 2480) |
| 369_F06 | EVQLLESGGGLVQPGGSLRLSCAASGFTFDDYSMNWVRQAPGKGLEWVAGINYNGGYKGYADSVKGRFTISRDNSKNTLYLQMNSLRAEDTAVYYCARSANWHDTALDYWGQGTLVTVSS (SEQ ID NO: 2233) | DIQMTQSPSSLSASVGDRVTITCRASQSIVSYVNWYQQKPGKAPKLVIYAATSRASGVPSRFSGSGSGTDFTLTISSLQPEDFATYYCQQSYDSPLTFGGGTKVEIK (SEQ ID NO: 2481) |
| 369_F10 | EVQLLESGGGLVQPGGSLRLSCAASGFTFDSYGMNWVRQAPGKGLEWVSNINYNSGYKSYADSVKGRFTISRDNSKNTLYLQMNSLRAEDTAVYYCARSANWHDTALDYWGQGTLVTVSS (SEQ ID NO: 2234) | DIQMTQSPSSLSASVGDRVTITCRASQSIVTYLNWYQQKPGKAPKLLIYAVTSRASGVPSRFSGSGSGTDFTLTISSLQPEDFATYYCQQSYDLPLTFGGGTKVEIK (SEQ ID NO: 2482) |
| 369_F11 | EVQLLESGGGLVQPGGSLRLSCAASGFTFDSYGMNWVRQAPGKGLEWVSNINYNSGYKSYADSVKGRFTISRDNSKNTLYLQMNSLRAEDTAVYYCARSANWHDTALDYWGQGTLVTVSS (SEQ ID NO: 2235) | DIQMTQSPSSLSASVGDRVTITCRASQSIISYLNWYQQKPGKAPKLLIYAATSRASGVPSRFSGSGSGTDFTLTISSLQPEDFATYYCQQSYDLPLTFGGGTKVEIK (SEQ ID NO: 2483) |
| 369_G01 | EVQLLESGGGLVQPGGSLRLSCAASGFTFSSYSMNWVRQAPGKGLEWVSNINYNSGYKSYADSVKGRFTISRDNSKNTLYLQMNSLRAEDTAVYYCARSANWHDTALDYWGQGTLVTVSS (SEQ ID NO: 2236) | DIQMTQSPSSLSASVGDRVTITCRASQSILSYVNWYQQKPGKAPKLLIYAATSRASGVPSRFSGSGSGTDFTLTISSLQPEDFATYYCQQSYSSPLTFGGGTKVEIK (SEQ ID NO: 2484) |
| 369_G04 | EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARSANWHDTALDYWGQGTLVTVSS (SEQ ID NO: 2237) | DIQMTQSPSSLSASVGDRVTITCRASQSILTYVNWYQQKPGKAPKLLIYATTSRHSGVPSRFSGSGSGTDFTLTISSLQPEDFATYYCQQSYETPLTFGGGTKVEIK (SEQ ID NO: 2485) |
| 369_G06 | EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2238) | DIQMTQSPSSLSASVGDRVTITCRASQSILSYVNWYQQKPGKAPKLVIYAATSRASGVPSRFSGSGSGTDFTLTISSLQPEDFATYYCQQSYENPLTFGGGTKVEIK (SEQ ID NO: 2486) |
| 369_G11 | EVQLLESGGGLVQPGGSLRLSCAASGFTFSSYSMNWVRQAPGKGLEWVANINYNSGYKGYADSVKGRFTISRDNSKNTLYLQMNSLRAEDTAVYYCARSANWHDTALDYWGQGTLVTVSS (SEQ ID NO: 2239) | DIQMTQSPSSLSASVGDRVTITCRASQSILTYLNWYQQKPGKAPKLLIYAATSLASGVPSRFSGSGSGTDFTLTISSLQPEDFATYYCQQSYESPLTFGGGTKVEIK (SEQ ID NO: 2487) |
| 369_G12 | EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2240) | DIQMTQSPSSLSASVGDRVTITCRASQSILTYVNWYQQKPGKAPKLLIYAATSRHSGVPSRFSGSGSGTDFTLTISSLQPEDFATYYCQQSDNTPLTFGGGTKVEIK (SEQ ID NO: 2488) |
| 369_H05 | EVQLLESGGGLVQPGGSLRLSCAASGFTFSSYGMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2241) | DIQMTQSPSSLSASVGDRVTITCRASQSIVSYVNWYQQKPGKAPKLLIYAATSRASGVPSRFSGSGSGTDFTLTISSLQPEDFATYYCQQSYSNPLTFGGGTKVEIK (SEQ ID NO: 2489) |
| 369_H06 | EVQLLESGGGLVQPGGSLRLSCAASGFTFSSYGMNWVRQAPGKGLEWVANINYNGGYKSYADSVKGRFTISRDNSKNTLYLQMNSLRAEDTAVYYCARSANWHDTALDYWGQGTLVTVSS (SEQ ID NO: 2242) | DIQMTQSPSSLSASVGDRVTITCRASQSIVSYVNWYQQKPGKAPKLLIYAATSRASGVPSRFSGSGSGTDFTLTISSLQPEDFATYYCQQSYDTPLTFGGGTKVEIK (SEQ ID NO: 2490) |

TABLE 2E-continued

Group V Antibody Sequences

| Ab | VH sequence | VL sequence |
|---|---|---|
| 369_H09 | EVQLLESGGGLVQPGGSLRLSCAASGFT FDDYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2243) | DIQMTQSPSSLSASVGDRVTITCRASQSILSYVN WYQQKPGKAPKLLIYAVTSLASGVPSRFSGSGSG TDFTLTISSLQPEDFATYYCQQSYESPLTFGGGT KVEIK (SEQ ID NO: 2491) |
| 370_A01 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2244) | DIQMTQSPSSLSASVGDRVTITCRASQSISTYLN WYQQKPGKAPKLVIYAATSRASGVPSRFSGSGSG TDFTLTISSLQPEDFATYYCQQSYNLPLTFGGGT KVEIK (SEQ ID NO: 2492) |
| 370_A03 | EVQLLESGGGLVQPGGSLRLSCAASGFT FSSYSMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2245) | DIQMTQSPSSLSASVGDRVTITCRASQSILSYLN WYQQKPGKAPKLLIYAATSRASGVPSRFSGSGSG TDFTLTISSLQPEDFATYYCQQSYDSPLTFGGGT KVEIK (SEQ ID NO: 2493) |
| 370_A04 | EVQLLESGGGLVQPGGSLRLSCAASGFT FDSYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2246) | DIQMTQSPSSLSASVGDRVTITCRASQSIITYLN WYQQKPGKAPKLLIYAATSRASGVPSRFSGSGSG TDFTLTISSLQPEDFATYYCQQSYDNPLTFGGGT KVEIK (SEQ ID NO: 2494) |
| 370_A12 | EVQLLESGGGLVQPGGSLRLSCAASGFT FSSYGMNWVRQAPGKGLEWVAGINYNGG YTSYADSVKGRFTISRDNSKNTLYLQMN SLRAEDTAVYYCARSANWHDTALDYWGQ GTLVTVSS (SEQ ID NO: 2247) | DIQMTQSPSSLSASVGDRVTITCRASQSILTYLN WYQQKPGKAPKLLIYAATSLASGVPSRFSGSGSG TDFTLTISSLQPEDFATYYCQQSYDSPLTFGGGT KVEIK (SEQ ID NO: 2495) |
| 370_C01 | EVQLLESGGGLVQPGGSLRLSCAASGFT FDSYSMNWVRQAPGKGLEWVSGINYNSG YTGYADSVKGRFTISRDNSKNTLYLQMN SLRAEDTAVYYCARSANWHDTALDYWGQ GTLVTVSS (SEQ ID NO: 2248) | DIQMTQSPSSLSASVGDRVTITCRASQSILTYLN WYQQKPGKAPKLVIYAATSLASGVPSRFSGSGSG TDFTLTISSLQPEDFATYYCQQSYDTPLTFGGGT KVEIK (SEQ ID NO: 2496) |
| 370_C03 | EVQLLESGGGLVQPGGSLRLSCAASGFT FSSYGMNWVRQAPGKGLEWVAGINYNGG YKGYADSVKGRFTISRDNSKNTLYLQMN SLRAEDTAVYYCARSANWHDTALDYWGQ GTLVTVSS (SEQ ID NO: 2249) | DIQMTQSPSSLSASVGDRVTITCRASQSILTYLN WYQQKPGKAPKLLIYYVTNRQSGVPSRFSGSGSG TDFTLTISSLQPEDFATYYCQQSYSSPLTFGGGT KVEIK (SEQ ID NO: 2497) |
| 370_C05 | EVQLLESGGGLVQPGGSLRLSCAASGFT FSSYSMNWVRQAPGKGLEWVAGINYNSG YTGYADSVKGRFTISRDNSKNTLYLQMN SLRAEDTAVYYCARSANWHDTALDYWGQ GTLVTVSS (SEQ ID NO: 2250) | DIQMTQSPSSLSASVGDRVTITCRASQSILSYVN WYQQKPGKAPKLVIYAATSRASGVPSRFSGSGSG TDFTLTISSLQPEDFATYYCQQSYNSPLTFGGGT KVEIK (SEQ ID NO: 2498) |
| 370_C08 | EVQLLESGGGLVQPGGSLRLSCAASGFT FSSYGMNWVRQAPGKGLEWVAGINYNGG YKGYADSVKGRFTISRDNSKNTLYLQMN SLRAEDTAVYYCARSANWHDTALDYWGQ GTLVTVSS (SEQ ID NO: 2251) | DIQMTQSPSSLSASVGDRVTITCRASQSISNYLN WYQQKPGKAPKLLIYAVTSRASGVPSRFSGSGSG TDFTLTISSLQPEDFATYYCQQSYDSPLTFGGGT KVEIK (SEQ ID NO: 2499) |
| 370_C09 | EVQLLESGGGLVQPGGSLRLSCAASGFT FDSYGMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2252) | DIQMTQSPSSLSASVGDRVTITCRASQSIISYLN WYQQKPGKAPKLVIYAATSLASGVPSRFSGSGSG TDFTLTISSLQPEDFATYYCQQSYSTPLTFGGGT KVEIK (SEQ ID NO: 2500) |
| 370_D04 | EVQLLESGGGLVQPGGSLRLSCAASGFT FDSYSMNWVRQAPGKGLEWVANINYNSG YKGYADSVKGRFTISRDNSKNTLYLQMN SLRAEDTAVYYCARSANWHDTALDYWGQ GTLVTVSS (SEQ ID NO: 2253) | DIQMTQSPSSLSASVGDRVTITCRASQSILTYLN WYQQKPGKAPKLVIYAATSRASGVPSRFSGSGSG TDFTLTISSLQPEDFATYYCQQSYDNPLTFGGGT KVEIK (SEQ ID NO: 2501) |
| 370_D11 | EVQLLESGGGLVQPGGSLRLSCAASGFT FDSYSMNWVRQAPGKGLEWVSGINYNGG YTGYADSVKGRFTISRDNSKNTLYLQMN SLRAEDTAVYYCARSANWHDTALDYWGQ GTLVTVSS (SEQ ID NO: 2254) | DIQMTQSPSSLSASVGDRVTITCRASQSIVSYLN WYQQKPGKAPKLLIYAATSRASGVPSRFSGSGSG TDFTLTISSLQPEDFATYYCQQSYDTPLTFGGGT KVEIK (SEQ ID NO: 2502) |

TABLE 2E-continued

Group V Antibody Sequences

| Ab | VH sequence | VL sequence |
|---|---|---|
| 370_E03 | EVQLLESGGGLVQPGGSLRLSCAASGFTFSSYGMNWVRQAPGKGLEWVSSINYGGYKGYADSVKGRFTISRDNSKNTLYLQMNSLRAEDTAVYYCARSANWHDTALDYWGQGTLVTVSS (SEQ ID NO: 2255) | DIQMTQSPSSLSASVGDRVTITCRASQSILTYLNWYQQKPGKAPKLVIYYASNRASGVPSRFSGSGSGTDFTLTISSLQPEDFATYYCQQSYDSPLTFGGGTKVEIK (SEQ ID NO: 2503) |
| 370_E06 | EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARSANWHDTALDYWGQGTLVTVSS (SEQ ID NO: 2256) | DIQMTQSPSSLSASVGDRVTITCRASQSILSYLNWYQQKPGKAPKLVIYATTSLASGVPSRFSGSGSGTDFTLTISSLQPEDFATYYCQQSYDTPLTFGGGTKVEIK (SEQ ID NO: 2504) |
| 370_E09 | EVQLLESGGGLVQPGGSLRLSCAASGFTFDDSSMHWVRQAPGKGLEWVSNINYNGGYTGYADSVKGRFTISRDNSKNTLYLQMNSLRAEDTAVYYCAKSANWHDTALDYWGQGTLVTVSS (SEQ ID NO: 2257) | DIQMTQSPSSLSASVGDRVTITCRASQSILSYVNWYQQKPGKAPKLVIYAATSRASGVPSRFSGSGSGTDFTLTISSLQPEDFATYYCQQSYELPLTFGGGTKVEIK (SEQ ID NO: 2505) |
| 370_F05 | EVQLLESGGGLVQPGGSLRLSCAASGFTFSSYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2258) | DIQMTQSPSSLSASVGDRVTITCRASQSIVSYVNWYQQKPGKAPKLVIYAATSRASGVPSRFSGSGSGTDFTLTISSLQPEDFATYYCQQSYETPLTFGGGTKVEIK (SEQ ID NO: 2506) |
| 370_F07 | EVQLLESGGGLVQPGGSLRLSCAASGFTFDSYSMNWVRQAPGKGLEWVSNINYNGGYKGYADSVKGRFTISRDNSKNTLYLQMNSLRAEDTAVYYCARSANWHDTALDYWGQGTLVTVSS (SEQ ID NO: 2259) | DIQMTQSPSSLSASVGDRVTITCRASQSILSYLNWYQQKPGKAPKLLIYAATSRASGVPSRFSGSGSGTDFTLTISSLQPEDFATYYCQQSYNLPLTFGGGTKVEIK (SEQ ID NO: 2507) |
| 370_F10 | EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2260) | DIQMTQSPSSLSASVGDRVTITCRASQSIVSYLNWYQQKPGKAPKLVIYAATSRASGVPSRFSGSGSGTDFTLTISSLQPEDFATYYCQQSYNSPLTFGGGTKVEIK (SEQ ID NO: 2508) |
| 370_G02 | EVQLLESGGGLVQPGGSLRLSCAASGFTFSDYSMNWVRQAPGKGLEWVANINYNGGYKGYADSVKGRFTISRDNSKNTLYLQMNSLRAEDTAVYYCARSANWHDTALDYWGQGTLVTVSS (SEQ ID NO: 2261) | DIQMTQSPSSLSASVGDRVTITCRASQSIVSYLNWYQQKPGKAPKLLIYAATSRHSGVPSRFSGSGSGTDFTLTISSLQPEDFATYYCQQSYDSPLTFGGGTKVEIK (SEQ ID NO: 2509) |
| 370_G03 | EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2262) | DIQMTQSPSSLSASVGDRVTITCRASQSILTYVNWYQQKPGKAPKLVIYATTSRASGVPSRFSGSGSGTDFTLTISSLQPEDFATYYCQQSYNNPLTFGGGTKVEIK (SEQ ID NO: 2510) |
| 370_G06 | EVQLLESGGGLVQPGGSLRLSCAASGFTFSDYGMHWVRQAPGKGLEWVSSINYNGGYTSYADSVKGRFTISRDNSKNTLYLQMNSLRAEDTAVYYCARSANWHDTALDYWGQGTLVTVSS (SEQ ID NO: 2263) | DIQMTQSPSSLSASVGDRVTITCRASQSILSYVNWYQQKPGKAPKLVIYAATSRASGVPSRFSGSGSGTDFTLTISSLQPEDFATYYCQQSDNTPLTFGGGTKVEIK (SEQ ID NO: 2511) |
| 370_G09 | EVQLLESGGGLVQPGGSLRLSCAASGFTFSSYGMNWVRQAPGKGLEWVAGINYNGGYKSYADSVKGRFTISRDNSKNTLYLQMNSLRAEDTAVYYCARSANWHDTALDYWGQGTLVTVSS (SEQ ID NO: 2264) | DIQMTQSPSSLSASVGDRVTITCRASQSILSYVNWYQQKPGKAPKLVIYAATSRASGVPSRFSGSGSGTDFTLTISSLQPEDFATYYCQQSYESPLTFGGGTKVEIK (SEQ ID NO: 2512) |
| 370_G10 | EVQLLESGGGLVQPGGSLRLSCAASGFTFSDYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2265) | DIQMTQSPSSLSASVGDRVTITCRASQSISSYLNWYQQKPGKAPKLLIYVVNNRASGVPSRFSGSGSGTDFTLTISSLQPEDFATYYCQQSYENPLTFGGGTKVEIK (SEQ ID NO: 2513) |
| 370_G11 | EVQLLESGGGLVQPGGSLRLSCAASGFTFSSYSMNWVRQAPGKGLEWVASINYNSGYTSYADSVKGRFTISRDNSKNTLYLQMNSLRAEDTAVYYCARSANWHDTHLDYWGQGTLVTVSS (SEQ ID NO: 2266) | DIQMTQSPSSLSASVGDRVTITCRASQSIVSYLNWYQQKPGKAPKLVIYAATSRASGVPSRFSGSGSGTDFTLTISSLQPEDFATYYCQQSYSLPLTFGGGTKVEIK (SEQ ID NO: 2514) |

TABLE 2E-continued

Group V Antibody Sequences

| Ab | VH sequence | VL sequence |
|---|---|---|
| 370_H01 | EVQLLESGGGLVQPGGSLRLSCAASGFTFSSYSMNWVRQAPGKGLEWVSGINYNSGYKGYADSVKGRFTISRDNSKNTLYLQMNSLRAEDTAVYYCARSANWHDTALDYWGQGTLVTVSS (SEQ ID NO: 2267) | DIQMTQSPSSLSASVGDRVTITCRASQSIISYLNWYQQKPGKAPKLLIYAVTSRASGVPSRFSGSGSGTDFTLTISSLQPEDFATYYCQQSYDTPLTFGGGTKVEIK (SEQ ID NO: 2515) |
| 370_H09 | EVQLLESGGGLVQPGGSLRLSCAASGFTFSSYGMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2268) | DIQMTQSPSSLSASVGDRVTITCRASQSIVSYVNWYQQKPGKAPKLLIYAATSRASGVPSRFSGSGSGTDFTLTISSLQPEDFATYYCQQSYDNPLTFGGGTKVEIK (SEQ ID NO: 2516) |
| 371_A03 | EVQLLESGGGLVQPGGSLRLSCAASGFTFSDYGMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2269) | DIQMTQSPSSLSASVGDRVTITCRASQSILSYLNWYQQKPGKAPKLVIYATTSRASGVPSRFSGSGSGTDFTLTISSLQPEDFATYYCQQSYESPLTFGGGTKVEIK (SEQ ID NO: 2517) |
| 371_A06 | EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2270) | DIQMTQSPSSLSASVGDRVTITCRASQSILTYLNWYQQKPGKAPKLVIYAATSRHSGVPSRFSGSGSGTDFTLTISSLQPEDFATYYCQQSYDSPLTFGGGTKVEIK (SEQ ID NO: 2518) |
| 371_A07 | EVQLLESGGGLVQPGGSLRLSCAASGFTFSDYSMNWVRQAPGKGLEWVSNINYNGGYKSYADSVKGRFTISRDNSKNTLYLQMNSLRAEDTAVYYCARSANWHDTALDYWGQGTLVTVSS (SEQ ID NO: 2271) | DIQMTQSPSSLSASVGDRVTITCRASQSILSYLNWYQQKPGKAPKLVIYATTSRASGVPSRFSGSGSGTDFTLTISSLQPEDFATYYCQQSYDLPLTFGGGTKVEIK (SEQ ID NO: 2519) |
| 371_A08 | EVQLLESGGGLVQPGGSLRLSCAASGFTFSSYGMHWVRQAPGKGLEWVSSINYNGGYTSYADSVKGRFTISRDNSKNTLYLQMNSLRAEDTAVYYCARSANWHDTALDYWGQGTLVTVSS (SEQ ID NO: 2272) | DIQMTQSPSSLSASVGDRVTITCRASQSILSYLNWYQQKPGKAPKLVIYAATSRASGVPSRFSGSGSGTDFTLTISSLQPEDFATYYCQQSYELPLTFGGGTKVEIK (SEQ ID NO: 2520) |
| 371_A12 | EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSANWHDTALDYWGQGTLVTVSS (SEQ ID NO: 2273) | DIQMTQSPSSLSASVGDRVTITCRASQSILSYVNWYQQKPGKAPKLVIYAATSLASGVPSRFSGSGSGTDFTLTISSLQPEDFATYYCQQSYDTPLTFGGGTKVEIK (SEQ ID NO: 2521) |
| 371_B06 | EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARSANWHDTALDYWGQGTLVTVSS (SEQ ID NO: 2274) | DIQMTQSPSSLSASVGDRVTITCRASQSILTYVNWYQQKPGKAPKLVIYAATSRHSGVPSRFSGSGSGTDFTLTISSLQPEDFATYYCQQSYNLPLTFGGGTKVEIK (SEQ ID NO: 2522) |
| 371_B07 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2275) | DIQMTQSPSSLSASVGDRVTITCRASQSILTYVNWYQQKPGKAPKLLIYAATSRASGVPSRFSGSGSGTDFTLTISSLQPEDFATYYCQQSYELPLTFGGGTKVEIK (SEQ ID NO: 2523) |
| 371_C03 | EVQLLESGGGLVQPGGSLRLSCAASGFTFSSYSMNWVRQAPGKGLEWVSNINYNGGYKGYADSVKGRFTISRDNSKNTLYLQMNSLRAEDTAVYYCARSANWHDTALDYWGQGTLVTVSS (SEQ ID NO: 2276) | DIQMTQSPSSLSASVGDRVTITCRASQSILSYLNWYQQKPGKAPKLVIYATTSRASGVPSRFSGSGSGTDFTLTISSLQPEDFATYYCQQSYSTPLTFGGGTKVEIK (SEQ ID NO: 2524) |
| 371_D06 | EVQLLESGGGLVQPGGSLRLSCAASGFTFDDYSMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2277) | DIQMTQSPSSLSASVGDRVTITCRASQSIISYVNWYQQKPGKAPKLLIYAATSRASGVPSRFSGSGSGTDFTLTISSLQPEDFATYYCQQSYSTPLTFGGGTKVEIK (SEQ ID NO: 2525) |
| 371_D09 | EVQLLESGGGLVQPGGSLRLSCAASGFTFSSYSMNWVRQAPGKGLEWVSNINYNSGYTGYADSVKGRFTISRDNSKNTLYLQMNSLRAEDTAVYYCARSANWHDTALDYWGQGTLVTVSS (SEQ ID NO: 2278) | DIQMTQSPSSLSASVGDRVTITCRASQSILTYLNWYQQKPGKAPKLVIYAATSRASGVPSRFSGSGSGTDFTLTISSLQPEDFATYYCQQSYNNPLTFGGGTKVEIK (SEQ ID NO: 2526) |

TABLE 2E-continued

Group V Antibody Sequences

| Ab | VH sequence | VL sequence |
|---|---|---|
| 371_F01 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSANWHDTALDYWGQGTLVTVSS (SEQ ID NO: 2279) | DIQMTQSPSSLSASVGDRVTITCRASQSILTYVNWYQQKPGKAPKLVIYAATSLASGVPSRFSGSGSGTDFTLTISSLQPEDFATYYCQQSYNNPLTFGGGTKVEIK (SEQ ID NO: 2527) |
| 371_F04 | EVQLLESGGGLVQPGGSLRLSCAASGFTFDSYSMNWVRQAPGKGLEWVAGINYNSGYKGYADSVKGRFTISRDNSKNTLYLQMNSLRAEDTAVYYCARSANWHDTALDYWGQGTLVTVSS (SEQ ID NO: 2280) | DIQMTQSPSSLSASVGDRVTITCRASQSILSYLNWYQQKPGKAPKLLIYAATSRHSGVPSRFSGSGSGTDFTLTISSLQPEDFATYYCQQSYNNPLTFGGGTKVEIK (SEQ ID NO: 2528) |
| 371_F06 | EVQLLESGGGLVQPGGSLRLSCAASGFTFDSYSMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2281) | DIQMTQSPSSLSASVGDRVTITCRASQSIVSYLNWYQQKPGKAPKLVIYAATSRHSGVPSRFSGSGSGTDFTLTISSLQPEDFATYYCQQSYNSPLTFGGGTKVEIK (SEQ ID NO: 2529) |
| 371_F08 | EVQLLESGGGLVQPGGSLRLSCAASGFTFDDYSMNWVRQAPGKGLEWVSGINYNGGYTGYADSVKGRFTISRDNSKNTLYLQMNSLRAEDTAVYYCARSANWHDTALDYWGQGTLVTVSS (SEQ ID NO: 2282) | DIQMTQSPSSLSASVGDRVTITCRASQSIVSYVNWYQQKPGKAPKLVIYAATSRHSGVPSRFSGSGSGTDFTLTISSLQPEDFATYYCQQSYESPLTFGGGTKVEIK (SEQ ID NO: 2530) |
| 371_G05 | EVQLLESGGGLVQPGGSLRLSCAASGFTFDSYSMNWVRQAPGKGLEWVSGINYNSGYTGYADSVKGRFTISRDNSKNTLYLQMNSLRAEDTAVYYCARSANWHDTALDYWGQGTLVTVSS (SEQ ID NO: 2283) | DIQMTQSPSSLSASVGDRVTITCRASQSISSYLNWYQQKPGKAPKLLIYAVTSRASGVPSRFSGSGSGTDFTLTISSLQPEDFATYYCQQSYSSPLTFGGGTKVEIK (SEQ ID NO: 2531) |
| 371_G10 | EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARSANWHDTALDYWGQGTLVTVSS (SEQ ID NO: 2284) | DIQMTQSPSSLSASVGDRVTITCRASQSISSYVNWYQQKPGKAPKLLIYAATSRHSGVPSRFSGSGSGTDFTLTISSLQPEDFATYYCQQSDDSPLTFGGGTKVEIK (SEQ ID NO: 2532) |
| 371_H09 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSANWHDTALDYWGQGTLVTVSS (SEQ ID NO: 2285) | DIQMTQSPSSLSASVGDRVTITCRASQSILTYVNWYQQKPGKAPKLVIYAATSLASGVPSRFSGSGSGTDFTLTISSLQPEDFATYYCQQSYDSPLTFGGGTKVEIK (SEQ ID NO: 2533) |
| 372_A04 | EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2286) | DIQMTQSPSSLSASVGDRVTITCRASQSILTYLNWYQQKPGKAPKLVIYAATSRASGVPSRFSGSGSGTDFTLTISSLQPEDFATYYCQQSYETPLTFGGGTKVEIK (SEQ ID NO: 2534) |
| 372_B04 | EVQLLESGGGLVQPGGSLRLSCAASGFTFDSYGMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2287) | DIQMTQSPSSLSASVGDRVTITCRASQSILSYVNWYQQKPGKAPKLVIYAATSLASGVPSRFSGSGSGTDFTLTISSLQPEDFATYYCQQSYDSPLTFGGGTKVEIK (SEQ ID NO: 2535) |
| 372_C07 | EVQLLESGGGLVQPGGSLRLSCAASGFTFSDYSMNWVRQAPGKGLEWVSNINYNSGYTSYADSVKGRFTISRDNSKNTLYLQMNSLRAEDTAVYYCARSANWHDTHLDYWGQGTLVTVSS (SEQ ID NO: 2288) | DIQMTQSPSSLSASVGDRVTITCRASQSILSYLNWYQQKPGKAPKLVIYAATSRHSGVPSRFSGSGSGTDFTLTISSLQPEDFATYYCQQSDNTPLTFGGGTKVEIK (SEQ ID NO: 2536) |
| 372_D02 | EVQLLESGGGLVQPGGSLRLSCAASGFTFSSYGMHWVRQAPGKGLEWVAGINYNGGYTGYADSVKGRFTISRDNSKNTLYLQMNSLRAEDTAVYYCARSANWHDTALDYWGQGTLVTVSS (SEQ ID NO: 2289) | DIQMTQSPSSLSASVGDRVTITCRASQSILTYLNWYQQKPGKAPKLVIYAATSRASGVPSRFSGSGSGTDFTLTISSLQPEDFATYYCQQSYDNPLTFGGGTKVEIK (SEQ ID NO: 2537) |
| 372_F03 | EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2290) | DIQMTQSPSSLSASVGDRVTITCRASQSILSYLNWYQQKPGKAPKLVIYAATSRASGVPSRFSGSGSGTDFTLTISSLQPEDFATYYCQQSYDTPLTFGGGTKVEIK (SEQ ID NO: 2538) |

TABLE 2E-continued

Group V Antibody Sequences

| Ab | VH sequence | VL sequence |
|---|---|---|
| 372_F06 | EVQLLESGGGLVQPGGSLRLSCAASGFT FSDYGMNWVRQAPGKGLEWVAGINYNGG YKSYADSVKGRFTISRDNSKNTLYLQMN SLRAEDTAVYYCARSANWHDTALDYWGQ GTLVTVSS (SEQ ID NO: 2291) | DIQMTQSPSSLSASVGDRVTITCRASQSILSYVN WYQQKPGKAPKLLIYAATSLASGVPSRFSGSGSG TDFTLTISSLQPEDFATYYCQQSYETPLTFGGGT KVEIK (SEQ ID NO: 2539) |
| 372_F08 | EVQLLESGGGLVQPGGSLRLSCAASGFT FSDYSMNWVRQAPGKGLEWVSNINYNSG YTGYADSVKGRFTISRDNSKNTLYLQMN SLRAEDTAVYYCARSANWHDTALDYWGQ GTLVTVSS (SEQ ID NO: 2292) | DIQMTQSPSSLSASVGDRVTITCRASQSILTYVN WYQQKPGKAPKLVIYAATSRASGVPSRFSGSGSG TDFTLTISSLQPEDFATYYCQQSYDTPLTFGGGT KVEIK (SEQ ID NO: 2540) |
| 372_F09 | EVQLLESGGGLVQPGGSLRLSCAASGFT FDSYSMNWVRQAPGKGLEWVANINYNSG YKGYADSVKGRFTISRDNSKNTLYLQMN SLRAEDTAVYYCARSANWHDTALDYWGQ GTLVTVSS (SEQ ID NO: 2293) | DIQMTQSPSSLSASVGDRVTITCRASQSILTYLN WYQQKPGKAPKLVIYAATSLASGVPSRFSGSGSG TDFTLTISSLQPEDFATYYCQQSYSSPLTFGGGT KVEIK (SEQ ID NO: 2541) |
| 373_A02 | EVQLLESGGGLVQPGGSLRLSCAASGFT FDSYGMNWVRQAPGKGLEWVSGINYNGG YKGYADSVKGRFTISRDNSKNTLYLQMN SLRAEDTAVYYCARSANWHDTALDYWGQ GTLVTVSS (SEQ ID NO: 2294) | DIQMTQSPSSLSASVGDRVTITCRASQSILSYVN WYQQKPGKAPKLVIYATTSLASGVPSRFSGSGSG TDFTLTISSLQPEDFATYYCQQSYNTPLTFGGGT KVEIK (SEQ ID NO: 2542) |
| 373_A08 | EVQLLESGGGLVQPGGSLRLSCAASGFT FDSYGMNWVRQAPGKGLEWVSNINYNGG YTGYADSVKGRFTISRDNSKNTLYLQMN SLRAEDTAVYYCARSANWHDTALDYWGQ GTLVTVSS (SEQ ID NO: 2295) | DIQMTQSPSSLSASVGDRVTITCRASQSIVSYVN WYQQKPGKAPKLLIYAATSLASGVPSRFSGSGSG TDFTLTISSLQPEDFATYYCQQSYSLPLTFGGGT KVEIK (SEQ ID NO: 2543) |
| 373_A10 | EVQLLESGGGLVQPGGSLRLSCAASGFT FSSYGMNWVRQAPGKGLEWVSGINYNSG YTSYADSVKGRFTISRDNSKNTLYLQMN SLRAEDTAVYYCARSANWHDTALDYWGQ GTLVTVSS (SEQ ID NO: 2296) | DIQMTQSPSSLSASVGDRVTITCRASQSILSYLN WYQQKPGKAPKLVIYAATSRASGVPSRFSGSGSG TDFTLTISSLQPEDFATYYCQQSYDLPLTFGGGT KVEIK (SEQ ID NO: 2544) |
| 373_B04 | EVQLLESGGGLVQPGGSLRLSCAASGFT FSSYGMNWVRQAPGKGLEWVAGINYNSG YKGYADSVKGRFTISRDNSKNTLYLQMN SLRAEDTAVYYCARSANWHDTALDYWGQ GTLVTVSS (SEQ ID NO: 2297) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 2545) |
| 373_B06 | EVQLLESGGGLVQPGGSLRLSCAASGFT FSDYSMNWVRQAPGKGLEWVAGINYNGG YTGYADSVKGRFTISRDNSKNTLYLQMN SLRAEDTAVYYCARSANWHDTALDYWGQ GTLVTVSS (SEQ ID NO: 2298) | DIQMTQSPSSLSASVGDRVTITCRASQSILTYVN WYQQKPGKAPKLVIYAATSRHSGVPSRFSGSGSG TDFTLTISSLQPEDFATYYCQQSYESPLTFGGGT KVEIK (SEQ ID NO: 2546) |
| 373_B10 | EVQLLESGGGLVQPGGSLRLSCAASGFT FDSYGMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2299) | DIQMTQSPSSLSASVGDRVTITCRASQSILSYLN WYQQKPGKAPKLLIYAATSRASGVPSRFSGSGSG TDFTLTISSLQPEDFATYYCQQSYDLPLTFGGGT KVEIK (SEQ ID NO: 2547) |
| 373_B12 | EVQLLESGGGLVQPGGSLRLSCAASGFT FDSYGMNWVRQAPGKGLEWVSSINYNSG YTSYADSVKGRFTISRDNSKNTLYLQMN SLRAEDTAVYYCARSANWHDTALDYWGQ GTLVTVSS (SEQ ID NO: 2300) | DIQMTQSPSSLSASVGDRVTITCRASQSIVSYVN WYQQKPGKAPKLLIYAATSRASGVPSRFSGSGSG TDFTLTISSLQPEDFATYYCQQSYDSPLTFGGGT KVEIK (SEQ ID NO: 2548) |
| 373_C02 | EVQLLESGGGLVQPGGSLRLSCAASGFT FDDYSMNWVRQAPGKGLEWVSGINYNSG YKGYADSVKGRFTISRDNSKNTLYLQMN SLRAEDTAVYYCARSANWHDTALDYWGQ GTLVTVSS (SEQ ID NO: 2301) | DIQMTQSPSSLSASVGDRVTITCRASQSILSYVN WYQQKPGKAPKLLIYAATSRASGVPSRFSGSGSG TDFTLTISSLQPEDFATYYCQQSYNTPLTFGGGT KVEIK (SEQ ID NO: 2549) |
| 373_C04 | EVQLLESGGGLVQPGGSLRLSCAASGFT FSSYSMNWVRQAPGKGLEWVANINYNSG YTGYADSVKGRFTISRDNSKNTLYLQMN SLRAEDTAVYYCARSANWHDTALDYWGQ GTLVTVSS (SEQ ID NO: 2302) | DIQMTQSPSSLSASVGDRVTITCRASQSIISYVN WYQQKPGKAPKLVIYAVTSRASGVPSRFSGSGSG TDFTLTISSLQPEDFATYYCQQSYNSPLTFGGGT KVEIK (SEQ ID NO: 2550) |

TABLE 2E-continued

Group V Antibody Sequences

| Ab | VH sequence | VL sequence |
|---|---|---|
| 373_C06 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSANWHDTALDYWGQGTLVTVSS (SEQ ID NO: 2303) | DIQMTQSPSSLSASVGDRVTITCRASQSIVSYVNWYQQKPGKAPKLVIYAATSRASGVPSRFSGSGSGTDFTLTISSLQPEDFATYYCQQSYDTPLTFGGGTKVEIK (SEQ ID NO: 2551) |
| 373_C08 | EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2304) | DIQMTQSPSSLSASVGDRVTITCRASQSIISYLNWYQQKPGKAPKLLIYAASSLQSGVPSRFSGSGSGTDFTLTISSLQPEDFATYYCQQSYNNPLTFGGGTKVEIK (SEQ ID NO: 2552) |
| 373_C11 | EVQLLESGGGLVQPGGSLRLSCAASGFTFSSYSMNWVRQAPGKGLEWVSGINYNSGYTGYADSVKGRFTISRDNSKNTLYLQMNSLRAEDTAVYYCARSANWHDTALDYWGQGTLVTVSS (SEQ ID NO: 2305) | DIQMTQSPSSLSASVGDRVTITCRASQSILTYVNWYQQKPGKAPKLVIYAVTSRASGVPSRFSGSGSGTDFTLTISSLQPEDFATYYCQQSYETPLTFGGGTKVEIK (SEQ ID NO: 2553) |
| 373_D01 | EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARSANWHDTHLDYWGQGTLVTVSS (SEQ ID NO: 2306) | DIQMTQSPSSLSASVGDRVTITCRASQSILSYVNWYQQKPGKAPKLVIYAATSRASGVPSRFSGSGSGTDFTLTISSLQPEDFATYYCQQSYDSPLTFGGGTKVEIK (SEQ ID NO: 2554) |
| 373_D04 | EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSANWHDTALDYWGQGTLVTVSS (SEQ ID NO: 2307) | DIQMTQSPSSLSASVGDRVTITCRASQSILSYLNWYQQKPGKAPKLLIYAATSRHSGVPSRFSGSGSGTDFTLTISSLQPEDFATYYCQQSYDSPLTFGGGTKVEIK (SEQ ID NO: 2555) |
| 373_D05 | EVQLLESGGGLVQPGGSLRLSCAASGFTFSSYSMNWVRQAPGKGLEWVSGINYNSGYKGYADSVKGRFTISRDNSKNTLYLQMNSLRAEDTAVYYCARSANWHDTALDYWGQGTLVTVSS (SEQ ID NO: 2308) | DIQMTQSPSSLSASVGDRVTITCRASQSILSYLNWYQQKPGKAPKLVIYAATSRASGVPSRFSGSGSGTDFTLTISSLQPEDFATYYCQQSYDSPLTFGGGTKVEIK (SEQ ID NO: 2556) |
| 373_D08 | EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARSANWHDTALDYWGQGTLVTVSS (SEQ ID NO: 2309) | DIQMTQSPSSLSASVGDRVTITCRASQSILSYVNWYQQKPGKAPKLLIYAATSRASGVPSRFSGSGSGTDFTLTISSLQPEDFATYYCQQSYDSPLTFGGGTKVEIK (SEQ ID NO: 2557) |
| 373_D10 | EVQLLESGGGLVQPGGSLRLSCAASGFTFDSYSMNWVRQAPGKGLEWVSNINYNSGYKGYADSVKGRFTISRDNSKNTLYLQMNSLRAEDTAVYYCARSANWHDTALDYWGQGTLVTVSS (SEQ ID NO: 2310) | DIQMTQSPSSLSASVGDRVTITCRASQSILSYVNWYQQKPGKAPKLLIYAATSRASGVPSRFSGSGSGTDFTLTISSLQPEDFATYYCQQSYDLPLTFGGGTKVEIK (SEQ ID NO: 2558) |
| 373_E01 | EVQLLESGGGLVQPGGSLRLSCAASGFTFSSYGMNWVRQAPGKGLEWVSGINYNGGYKGYADSVKGRFTISRDNSKNTLYLQMNSLRAEDTAVYYCARSANWHDTALDYWGQGTLVTVSS (SEQ ID NO: 2311) | DIQMTQSPSSLSASVGDRVTITCRASQSIVSYVNWYQQKPGKAPKLLIYAATSRHSGVPSRFSGSGSGTDFTLTISSLQPEDFATYYCQQSYNNPLTFGGGTKVEIK (SEQ ID NO: 2559) |
| 373_E05 | EVQLLESGGGLVQPGGSLRLSCAASGFTFDSYGMNWVRQAPGKGLEWVSNINYNSGYTSYADSVKGRFTISRDNSKNTLYLQMNSLRAEDTAVYYCARSANWHDTALDYWGQGTLVTVSS (SEQ ID NO: 2312) | DIQMTQSPSSLSASVGDRVTITCRASQSILSYVNWYQQKPGKAPKLVIYAVTSRASGVPSRFSGSGSGTDFTLTISSLQPEDFATYYCQQSYDLPLTFGGGTKVEIK (SEQ ID NO: 2560) |
| 373_E07 | EVQLLESGGGLVQPGGSLRLSCAASGFTFSSYGMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2313) | DIQMTQSPSSLSASVGDRVTITCRASQSILTYVNWYQQKPGKAPKLLIYAATSLASGVPSRFSGSGSGTDFTLTISSLQPEDFATYYCQQSYETPLTFGGGTKVEIK (SEQ ID NO: 2561) |
| 373_E12 | EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2314) | DIQMTQSPSSLSASVGDRVTITCRASQSILSYVNWYQQKPGKAPKLVIYAATSRASGVPSRFSGSGSGTDFTLTISSLQPEDFATYYCQQSYDTPLTFGGGTKVEIK (SEQ ID NO: 2562) |

TABLE 2E-continued

Group V Antibody Sequences

| Ab | VH sequence | VL sequence |
|---|---|---|
| 373_G10 | EVQLLESGGGLVQPGGSLRLSCAASGFT FSDYGMNWVRQAPGKGLEWVSNINYNGG YKSYADSVKGRFTISRDNSKNTLYLQMN SLRAEDTAVYYCARSANWHDTALDYWGQ GTLVTVSS (SEQ ID NO: 2315) | DIQMTQSPSSLSASVGDRVTITCRASQSIVSYVN WYQQKPGKAPKLLIYAATSRASGVPSRFSGSGSG TDFTLTISSLQPEDFATYYCQQSYDLPLTFGGGT KVEIK (SEQ ID NO: 2563) |
| 373_G12 | EVQLLESGGGLVQPGGSLRLSCAASGFT FSSYSMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2316) | DIQMTQSPSSLSASVGDRVTITCRASQSILSYLN WYQQKPGKAPKLLIYATTSLASGVPSRFSGSGSG TDFTLTISSLQPEDFATYYCQQSYNSPLTFGGGT KVEIK (SEQ ID NO: 2564) |
| 373_H01 | EVQLLESGGGLVQPGGSLRLSCAASGFT FDSYSMNWVRQAPGKGLEWVANINYNGG YTGYADSVKGRFTISRDNSKNTLYLQMN SLRAEDTAVYYCARSANWHDTALDYWGQ GTLVTVSS (SEQ ID NO: 2317) | DIQMTQSPSSLSASVGDRVTITCRASQSILSYLN WYQQKPGKAPKLVIYAATSRASGVPSRFSGSGSG TDFTLTISSLQPEDFATYYCQQSYDNPLTFGGGT KVEIK (SEQ ID NO: 2565) |
| 373_H05 | EVQLLESGGGLVQPGGSLRLSCAASGFT FSDYSMNWVRQAPGKGLEWVANINYNGG YKGYADSVKGRFTISRDNSKNTLYLQMN SLRAEDTAVYYCARSANWHDTALDYWGQ GTLVTVSS (SEQ ID NO: 2318) | DIQMTQSPSSLSASVGDRVTITCRASQSILTYVN WYQQKPGKAPKLVIYAATSRASGVPSRFSGSGSG TDFTLTISSLQPEDFATYYCQQSYETPLTFGGGT KVEIK (SEQ ID NO: 2566) |
| 374_A07 | EVQLLESGGGLVQPGGSLRLSCAASGFT FSSYSMNWVRQAPGKGLEWVSGINYNSG YKGYADSVKGRFTISRDNSKNTLYLQMN SLRAEDTAVYYCARSANWHDTALDYWGQ GTLVTVSS (SEQ ID NO: 2319) | DIQMTQSPSSLSASVGDRVTITCRASQSILSYVN WYQQKPGKAPKLLIYAVTSRASGVPSRFSGSGSG TDFTLTISSLQPEDFATYYCQQSYDLPLTFGGGT KVEIK (SEQ ID NO: 2567) |
| 374_B04 | EVQLLESGGGLVQPGGSLRLSCAASGFT FSSYSMNWVRQAPGKGLEWVSNINYNSG YTGYADSVKGRFTISRDNSKNTLYLQMN SLRAEDTAVYYCARSANWHDTALDYWGQ GTLVTVSS (SEQ ID NO: 2320) | DIQMTQSPSSLSASVGDRVTITCRASQSIVSYLN WYQQKPGKAPKLLIYAVTSRASGVPSRFSGSGSG TDFTLTISSLQPEDFATYYCQQSYESPLTFGGGT KVEIK (SEQ ID NO: 2568) |
| 374_B06 | EVQLLESGGGLVQPGGSLRLSCAASGFT FDSYSMNWVRQAPGKGLEWVAGINYNSG YKGYADSVKGRFTISRDNSKNTLYLQMN SLRAEDTAVYYCARSANWHDTHLDYWGQ GTLVTVSS (SEQ ID NO: 2321) | DIQMTQSPSSLSASVGDRVTITCRASQSILTYVN WYQQKPGKAPKLLIYAATSRASGVPSRFSGSGSG TDFTLTISSLQPEDFATYYCQQSYDTPLTFGGGT KVEIK (SEQ ID NO: 2569) |
| 374_B12 | EVQLLESGGGLVQPGGSLRLSCAASGFT FDSYSMNWVRQAPGKGLEWVAGINYNGG YTGYADSVKGRFTISRDNSKNTLYLQMN SLRAEDTAVYYCARSANWHDTHLDYWGQ GTLVTVSS (SEQ ID NO: 2322) | DIQMTQSPSSLSASVGDRVTITCRASQSISSYLN WYQQKPGKAPKLVIYAATSRASGVPSRFSGSGSG TDFTLTISSLQPEDFATYYCQQSYDNPLTFGGGT KVEIK (SEQ ID NO: 2570) |
| 374_C03 | EVQLLESGGGLVQPGGSLRLSCAASGFT FDSYSMNWVRQAPGKGLEWVSGINYNSG YTSYADSVKGRFTISRDNSKNTLYLQMN SLRAEDTAVYYCARSANWHDTALDYWGQ GTLVTVSS (SEQ ID NO: 2323) | DIQMTQSPSSLSASVGDRVTITCRASQSILTYLN WYQQKPGKAPKLLIYAATSRASGVPSRFSGSGSG TDFTLTISSLQPEDFATYYCQQSYDSPLTFGGGT KVEIK (SEQ ID NO: 2571) |
| 374_C06 | EVQLLESGGGLVQPGGSLRLSCAASGFT FDDYSMNWVRQAPGKGLEWVSSINYNSG YKGYADSVKGRFTISRDNSKNTLYLQMN SLRAEDTAVYYCARSANWHDTALDYWGQ GTLVTVSS (SEQ ID NO: 2324) | DIQMTQSPSSLSASVGDRVTITCRASQSILTYVN WYQQKPGKAPKLLIYAATSRASGVPSRFSGSGSG TDFTLTISSLQPEDFATYYCQQSYNSPLTFGGGT KVEIK (SEQ ID NO: 2572) |
| 374_D01 | EVQLLESGGGLVQPGGSLRLSCAASGFT FDSYSMNWVRQAPGKGLEWVSGINYNSG YKGYADSVKGRFTISRDNSKNTLYLQMN SLRAEDTAVYYCARSANWHDTALDYWGQ GTLVTVSS (SEQ ID NO: 2325) | DIQMTQSPSSLSASVGDRVTITCRASQSIITYVN WYQQKPGKAPKLLIYAATSLASGVPSRFSGSGSG TDFTLTISSLQPEDFATYYCQQSYSSPLTFGGGT KVEIK (SEQ ID NO: 2573) |
| 374_D08 | EVQLLESGGGLVQPGGSLRLSCAASGFT FDSYGMNWVRQAPGKGLEWVSGINYNSG YTGYADSVKGRFTISRDNSKNTLYLQMN SLRAEDTAVYYCARSANWHDTHLDYWGQ GTLVTVSS (SEQ ID NO: 2326) | DIQMTQSPSSLSASVGDRVTITCRASQSILTYLN WYQQKPGKAPKLLIYAATSRHSGVPSRFSGSGSG TDFTLTISSLQPEDFATYYCQQSYESPLTFGGGT KVEIK (SEQ ID NO: 2574) |

TABLE 2E-continued

Group V Antibody Sequences

| Ab | VH sequence | VL sequence |
|---|---|---|
| 374_E01 | EVQLLESGGGLVQPGGSLRLSCAASGFT FSSYGMNWVRQAPGKGLEWVAGINYNGG YTSYADSVKGRFTISRDNSKNTLYLQMN SLRAEDTAVYYCARSANWHDTALDYWGQ GTLVTVSS (SEQ ID NO: 2327) | DIQMTQSPSSLSASVGDRVTITCRASQSISSYVN WYQQKPGKAPKLLIYAATSRASGVPSRFSGSGSG TDFTLTISSLQPEDFATYYCQQSYSTPLTFGGGT KVEIK (SEQ ID NO: 2575) |
| 374_E02 | EVQLLESGGGLVQPGGSLRLSCAASGFT FSSYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2328) | DIQMTQSPSSLSASVGDRVTITCRASQSILSYLN WYQQKPGKAPKLLIYAATSLASGVPSRFSGSGSG TDFTLTISSLQPEDFATYYCQQSYDLPLTFGGGT KVEIK (SEQ ID NO: 2576) |
| 374_E05 | EVQLLESGGGLVQPGGSLRLSCAASGFT FSSYSMNWVRQAPGKGLEWVAGINYNGG YTSYADSVKGRFTISRDNSKNTLYLQMN SLRAEDTAVYYCARSANWHDTALDYWGQ GTLVTVSS (SEQ ID NO: 2329) | DIQMTQSPSSLSASVGDRVTITCRASQSILSFVN WYQQKPGKAPKLVIYAATSRASGVPSRFSGSGSG TDFTLTISSLQPEDFATYYCQQSYNLPLTFGGGT KVEIK (SEQ ID NO: 2577) |
| 374_E07 | EVQLLESGGGLVQPGGSLRLSCAASGFT FSDYSMNWVRQAPGKGLEWVAGINYNGG YTSYADSVKGRFTISRDNSKNTLYLQMN SLRAEDTAVYYCARSANWHDTALDYWGQ GTLVTVSS (SEQ ID NO: 2330) | DIQMTQSPSSLSASVGDRVTITCRASQSIITYVN WYQQKPGKAPKLVIYAATSRASGVPSRFSGSGSG TDFTLTISSLQPEDFATYYCQQSYNTPLTFGGGT KVEIK (SEQ ID NO: 2578) |
| 374_E08 | EVQLLESGGGLVQPGGSLRLSCAASGFT FSSYGMNWVRQAPGKGLEWVAGINYNGG YKSYADSVKGRFTISRDNSKNTLYLQMN SLRAEDTAVYYCARSANWHDTALDYWGQ GTLVTVSS (SEQ ID NO: 2331) | DIQMTQSPSSLSASVGDRVTITCRASQSILSYLN WYQQKPGKAPKLLIYAATSRHSGVPSRFSGSGSG TDFTLTISSLQPEDFATYYCQQSYDLPLTFGGGT KVEIK (SEQ ID NO: 2579) |
| 374_E11 | EVQLLESGGGLVQPGGSLRLSCAASGFT FSSYGMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2332) | DIQMTQSPSSLSASVGDRVTITCRASQSIVTYLN WYQQKPGKAPKLVIYAATSRASGVPSRFSGSGSG TDFTLTISSLQPEDFATYYCQQSYDSPLTFGGGT KVEIK (SEQ ID NO: 2580) |
| 374_F01 | EVQLLESGGGLVQPGGSLRLSCAASGFT FDSYSMNWVRQAPGKGLEWVSNINYNGG YTGYADSVKGRFTISRDNSKNTLYLQMN SLRAEDTAVYYCARSANWHDTALDYWGQ GTLVTVSS (SEQ ID NO: 2333) | DIQMTQSPSSLSASVGDRVTITCRASQSILSYVN WYQQKPGKAPKLVIYAATSRHSGVPSRFSGSGSG TDFTLTISSLQPEDFATYYCQQSYENPLTFGGGT KVEIK (SEQ ID NO: 2581) |
| 374_F02 | EVQLLESGGGLVQPGGSLRLSCAASGFT FDSYSMNWVRQAPGKGLEWVANINYNSG YTSYADSVKGRFTISRDNSKNTLYLQMN SLRAEDTAVYYCARSANWHDTALDYWGQ GTLVTVSS (SEQ ID NO: 2334) | DIQMTQSPSSLSASVGDRVTITCRASQSIVSYLN WYQQKPGKAPKLLIYAASSLQSGVPSRFSGSGSG TDFTLTISSLQPEDFATYYCQQSYELPLTFGGGT KVEIK (SEQ ID NO: 2582) |
| 374_F04 | EVQLLESGGGLVQPGGSLRLSCAASGFT FSSYGMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2335) | DIQMTQSPSSLSASVGDRVTITCRASQSILTYVN WYQQKPGKAPKLLIYAATSRASGVPSRFSGSGSG TDFTLTISSLQPEDFATYYCQQSYNSPLTFGGGT KVEIK (SEQ ID NO: 2583) |
| 374_F10 | EVQLLESGGGLVQPGGSLRLSCAASGFT FSSYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2336) | DIQMTQSPSSLSASVGDRVTITCRASQSILSYLN WYQQKPGKAPKLLIYAATSRASGVPSRFSGSGSG TDFTLTISSLQPEDFATYYCQQSYDNPLTFGGGT KVEIK (SEQ ID NO: 2584) |
| 374_F11 | EVQLLESGGGLVQPGGSLRLSCAASGFT FDSYSMNWVRQAPGKGLEWVSNINYNGG YTGYADSVKGRFTISRDNSKNTLYLQMN SLRAEDTAVYYCARSANWHDTALDYWGQ GTLVTVSS (SEQ ID NO: 2337) | DIQMTQSPSSLSASVGDRVTITCRASQSILSYLN WYQQKPGKAPKLLIYAVTSLASGVPSRFSGSGSG TDFTLTISSLQPEDFATYYCQQSYESPLTFGGGT KVEIK (SEQ ID NO: 2585) |
| 374_G04 | EVQLLESGGGLVQPGGSLRLSCAASGFT FSSYSMNWVRQAPGKGLEWVAGINYNGG YTGYADSVKGRFTISRDNSKNTLYLQMN SLRAEDTAVYYCARSANWHDTALDYWGQ GTLVTVSS (SEQ ID NO: 2338) | DIQMTQSPSSLSASVGDRVTITCRASQSILTYLN WYQQKPGKAPKLVIYAATSLASGVPSRFSGSGSG TDFTLTISSLQPEDFATYYCQQSYDNPLTFGGGT KVEIK (SEQ ID NO: 2586) |

TABLE 2E-continued

Group V Antibody Sequences

| Ab | VH sequence | VL sequence |
|---|---|---|
| 374_G06 | EVQLLESGGGLVQPGGSLRLSCAASGFT FSSYGMHWVRQAPGKGLEWVASINYGG YTSYADSVKGRFTISRDNSKNTLYLQMN SLRAEDTAVYYCARSANWHDTALDYWGQ GTLVTVSS (SEQ ID NO: 2339) | DIQMTQSPSSLSASVGDRVTITCRASQSILSYLN WYQQKPGKAPKLLIYAVTSRASGVPSRFSGSGSG TDFTLTISSLQPEDFATYYCQQSYDLPLTFGGGT KVEIK (SEQ ID NO: 2587) |
| 374_G07 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2340) | DIQMTQSPSSLSASVGDRVTITCRASQSIISYLN WYQQKPGKAPKLLIYAATSRASGVPSRFSGSGSG TDFTLTISSLQPEDFATYYCQQSYDSPLTFGGGT KVEIK (SEQ ID NO: 2588) |
| 374_H03 | EVQLLESGGGLVQPGGSLRLSCAASGFT FSSYGMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2341) | DIQMTQSPSSLSASVGDRVTITCRASQSILSYVN WYQQKPGKAPKLVIYAATSRASGVPSRFSGSGSG TDFTLTISSLQPEDFATYYCQQSYDSPLTFGGGT KVEIK (SEQ ID NO: 2589) |
| 374_H04 | EVQLLESGGGLVQPGGSLRLSCAASGFT FDSYSMNWVRQAPGKGLEWVSGINYNSG YTSYADSVKGRFTISRDNSKNTLYLQMN SLRAEDTAVYYCARSANWHDTALDYWGQ GTLVTVSS (SEQ ID NO: 2342) | DIQMTQSPSSLSASVGDRVTITCRASQSILTYLN WYQQKPGKAPKLLIYAATSRASGVPSRFSGSGSG TDFTLTISSLQPEDFATYYCQQSYDNPLTFGGGT KVEIK (SEQ ID NO: 2590) |
| 374_H06 | EVQLLESGGGLVQPGGSLRLSCAASGFT FSSYGMNWVRQAPGKGLEWVSNINYNGG YTGYADSVKGRFTISRDNSKNTLYLQMN SLRAEDTAVYYCARSANWHDTALDYWGQ GTLVTVSS (SEQ ID NO: 2343) | DIQMTQSPSSLSASVGDRVTITCRASQSIVSYVN WYQQKPGKAPKLVIYAATSRASGVPSRFSGSGSG TDFTLTISSLQPEDFATYYCQQSYNLPLTFGGGT KVEIK (SEQ ID NO: 2591) |
| 374_H07 | EVQLLESGGGLVQPGGSLRLSCAASGFT FDSYGMNWVRQAPGKGLEWVANINYNGG YTGYADSVKGRFTISRDNSKNTLYLQMN SLRAEDTAVYYCARSANWHDTALDYWGQ GTLVTVSS (SEQ ID NO: 2344) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 2592) |
| 374_H09 | EVQLLESGGGLVQPGGSLRLSCAASGFT FSSYSMNWVRQAPGKGLEWVANINYNSG YKSYADSVKGRFTISRDNSKNTLYLQMN SLRAEDTAVYYCARSANWHDTALDYWGQ GTLVTVSS (SEQ ID NO: 2345) | DIQMTQSPSSLSASVGDRVTITCRASQSILSYLN WYQQKPGKAPKLVIYAVTSLASGVPSRFSGSGSG TDFTLTISSLQPEDFATYYCQQSYDLPLTFGGGT KVEIK (SEQ ID NO: 2593) |
| 375_A05 | EVQLLESGGGLVQPGGSLRLSCAASGFT FSSYGMNWVRQAPGKGLEWVANINYNGG YKGYADSVKGRFTISRDNSKNTLYLQMN SLRAEDTAVYYCARSANWHDTALDYWGQ GTLVTVSS (SEQ ID NO: 2346) | DIQMTQSPSSLSASVGDRVTITCRASQSILSYLN WYQQKPGKAPKLLIYAATSRASGVPSRFSGSGSG TDFTLTISSLQPEDFATYYCQQSYDLPLTFGGGT KVEIK (SEQ ID NO: 2594) |
| 375_C06 | EVQLLESGGGLVQPGGSLRLSCAASGFT FDDYGMHWVRQAPGKGLEWVASINYNSG YTSYADSVKGRFTISRDNSKNTLYLQMN SLRAEDTAVYYCARSANWHDTALDYWGQ GTLVTVSS (SEQ ID NO: 2347) | DIQMTQSPSSLSASVGDRVTITCRASQSILTYVN WYQQKPGKAPKLVIYATTSRASGVPSRFSGSGSG TDFTLTISSLQPEDFATYYCQQSYDSPLTFGGGT KVEIK (SEQ ID NO: 2595) |
| 375_D04 | EVQLLESGGGLVQPGGSLRLSCAASGFT FDDSSMHWVRQAPGKGLEWVSNINYNGG YTGYADSVKGRFTISRDNSKNTLYLQMN SLRAEDTAVYYCAKSANWHDTALDYWGQ GTLVTVSS (SEQ ID NO: 2348) | DIQMTQSPSSLSASVGDRVTITCRASQSILSYVN WYQQKPGKAPKLLIYAATSRASGVPSRFSGSGSG TDFTLTISSLQPEDFATYYCQQSYELPLTFGGGT KVEIK (SEQ ID NO: 2596) |
| 375_D05 | EVQLLESGGGLVQPGGSLRLSCAASGFT FSSYSMNWVRQAPGKGLEWVASINYNSG YTSYADSVKGRFTISRDNSKNTLYLQMN SLRAEDTAVYYCARSANWHDTHLDYWGQ GTLVTVSS (SEQ ID NO: 2349) | DIQMTQSPSSLSASVGDRVTITCRASQSIVSYLN WYQQKPGKAPKLLIYAATSLHSGVPSRFSGSGSG TDFTLTISSLQPEDFATYYCQQSYDTPLTFGGGT KVEIK (SEQ ID NO: 2597) |
| 375_D07 | EVQLLESGGGLVQPGGSLRLSCAASGFT FSSYGMNWVRQAPGKGLEWVANINYNSG YTGYADSVKGRFTISRDNSKNTLYLQMN SLRAEDTAVYYCARSANWHDTALDYWGQ GTLVTVSS (SEQ ID NO: 2350) | DIQMTQSPSSLSASVGDRVTITCRASQSIITYLN WYQQKPGKAPKLLIYAATSRASGVPSRFSGSGSG TDFTLTISSLQPEDFATYYCQQSYDTPLTFGGGT KVEIK (SEQ ID NO: 2598) |

TABLE 2E-continued

Group V Antibody Sequences

| Ab | VH sequence | VL sequence |
|---|---|---|
| 375_D08 | EVQLLESGGGLVQPGGSLRLSCAASGFT FSDYGMNWVRQAPGKGLEWVSGINYNSG YKGYADSVKGRFTISRDNSKNTLYLQMN SLRAEDTAVYYCARSANWHDTALDYWGQ GTLVTVSS (SEQ ID NO: 2351) | DIQMTQSPSSLSASVGDRVTITCRASQSIITYLN WYQQKPGKAPKLLIYAATSRASGVPSRFSGSGSG TDFTLTISSLQPEDFATYYCQQSYSTPLTFGGGT KVEIK (SEQ ID NO: 2599) |
| 375_D12 | EVQLLESGGGLVQPGGSLRLSCAASGFT FDSYGMNWVRQAPGKGLEWVSSINYNSG YTSYADSVKGRFTISRDNSKNTLYLQMN SLRAEDTAVYYCARSANWHDTALDYWGQ GTLVTVSS (SEQ ID NO: 2352) | DIQMTQSPSSLSASVGDRVTITCRASQSILTYVN WYQQKPGKAPKLVIYAATSRASGVPSRFSGSGSG TDFTLTISSLQPEDFATYYCQQSYETPLTFGGGT KVEIK (SEQ ID NO: 2600) |
| 375_E01 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2353) | DIQMTQSPSSLSASVGDRVTITCRASQSILTYLN WYQQKPGKAPKLVIYAATSRASGVPSRFSGSGSG TDFTLTISSLQPEDFATYYCQQSDDSPLTFGGGT KVEIK (SEQ ID NO: 2601) |
| 375_E07 | EVQLLESGGGLVQPGGSLRLSCAASGFT FSDYSMNWVRQAPGKGLEWVAGINYNSG YKGYADSVKGRFTISRDNSKNTLYLQMN SLRAEDTAVYYCARSANWHDTALDYWGQ GTLVTVSS (SEQ ID NO: 2354) | DIQMTQSPSSLSASVGDRVTITCRASQSIVTYLN WYQQKPGKAPKLLIYVVTNRESGVPSRFSGSGSG TDFTLTISSLQPEDFATYYCQQSYETPLTFGGGT KVEIK (SEQ ID NO: 2602) |
| 375_H12 | EVQLLESGGGLVQPGGSLRLSCAASGFT FSSYGMNWVRQAPGKGLEWVAGINYNGG YKGYADSVKGRFTISRDNSKNTLYLQMN SLRAEDTAVYYCARSANWHDTALDYWGQ GTLVTVSS (SEQ ID NO: 2355) | DIQMTQSPSSLSASVGDRVTITCRASQSILTYLN WYQQKPGKAPKLLIYYVTNRQSGVPSRFSGSGSG TDFTLTISSLQPEDFATYYCQQSYSIPLTFGGGT KVEIK (SEQ ID NO: 2603) |
| 376_A04 | EVQLLESGGGLVQPGGSLRLSCAASGFT FDSYSMNWVRQAPGKGLEWVSNINYNGG YTSYADSVKGRFTISRDNSKNTLYLQMN SLRAEDTAVYYCARSANWHDTALDYWGQ GTLVTVSS (SEQ ID NO: 2356) | DIQMTQSPSSLSASVGDRVTITCRASQSIVTYLN WYQQKPGKAPKLVIYAATSRASGVPSRFSGSGSG TDFTLTISSLQPEDFATYYCQQSYDSPLTFGGGT KVEIK (SEQ ID NO: 2604) |
| 376_A10 | EVQLLESGGGLVQPGGSLRLSCAASGFT FSDYGMNWVRQAPGKGLEWVSNINYNSG YKGYADSVKGRFTISRDNSKNTLYLQMN SLRAEDTAVYYCARSANWHDTALDYWGQ GTLVTVSS (SEQ ID NO: 2357) | DIQMTQSPSSLSASVGDRVTITCRASQSILSYLN WYQQKPGKAPKLLIYAATSRASGVPSRFSGSGSG TDFTLTISSLQPEDFATYYCQQSYESPLTFGGGT KVEIK (SEQ ID NO: 2605) |
| 376_A12 | EVQLLESGGGLVQPGGSLRLSCAASGFT FSSYSMNWVRQAPGKGLEWVANINYNSG YKGYADSVKGRFTISRDNSKNTLYLQMN SLRAEDTAVYYCARSANWHDTALDYWGQ GTLVTVSS (SEQ ID NO: 2358) | DIQMTQSPSSLSASVGDRVTITCRASQSILSYVN WYQQKPGKAPKLVIYAATSRASGVPSRFSGSGSG TDFTLTISSLQPEDFATYYCQQSYDTPLTFGGGT KVEIK (SEQ ID NO: 2606) |
| 376_B04 | EVQLLESGGGLVQPGGSLRLSCAASGFT FDSYGMHWVRQAPGKGLEWVASINYNGG YTGYADSVKGRFTISRDNSKNTLYLQMN SLRAEDTAVYYCARSANWHDTALDYWGQ GTLVTVSS (SEQ ID NO: 2359) | DIQMTQSPSSLSASVGDRVTITCRASQSIVSYVN WYQQKPGKAPKLVIYAATSRASGVPSRFSGSGSG TDFTLTISSLQPEDFATYYCQQSYDTPLTFGGGT KVEIK (SEQ ID NO: 2607) |
| 376_B05 | EVQLLESGGGLVQPGGSLRLSCAASGFT FSSYSMNWVRQAPGKGLEWVANINYNGG YTGYADSVKGRFTISRDNSKNTLYLQMN SLRAEDTAVYYCARSANWHDTALDYWGQ GTLVTVSS (SEQ ID NO: 2360) | DIQMTQSPSSLSASVGDRVTITCRASQSIISYVN WYQQKPGKAPKLVIYAATSRASGVPSRFSGSGSG TDFTLTISSLQPEDFATYYCQQSYELPLTFGGGT KVEIK (SEQ ID NO: 2608) |
| 376_B09 | EVQLLESGGGLVQPGGSLRLSCAASGFT FDSYSMNWVRQAPGKGLEWVANINYNSG YKGYADSVKGRFTISRDNSKNTLYLQMN SLRAEDTAVYYCARSANWHDTALDYWGQ GTLVTVSS (SEQ ID NO: 2361) | DIQMTQSPSSLSASVGDRVTITCRASQSILTYVN WYQQKPGKAPKLVIYAATSRASGVPSRFSGSGSG TDFTLTISSLQPEDFATYYCQQSYDLPLTFGGGT KVEIK (SEQ ID NO: 2609) |
| 376_B11 | EVQLLESGGGLVQPGGSLRLSCAASGFT FSSYSMNWVRQAPGKGLEWVSGINYNGG YTSYADSVKGRFTISRDNSKNTLYLQMN SLRAEDTAVYYCARSANWHDTALDYWGQ GTLVTVSS (SEQ ID NO: 2362) | DIQMTQSPSSLSASVGDRVTITCRASQSILSYVN WYQQKPGKAPKLVIYAATSRASGVPSRFSGSGSG TDFTLTISSLQPEDFATYYCQQSYDLPLTFGGGT KVEIK (SEQ ID NO: 2610) |

TABLE 2E-continued

| Group V Antibody Sequences | | |
|---|---|---|
| Ab | VH sequence | VL sequence |
| 376_C01 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2363) | DIQMTQSPSSLSASVGDRVTITCRASQSILTYLNWYQQKPGKAPKLLIYAATSLASGVPSRFSGSGSGTDFTLTISSLQPEDFATYYCQQSYDNPLTFGGGTKVEIK (SEQ ID NO: 2611) |
| 376_C02 | EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARSANWHDTALDYWGQGTLVTVSS (SEQ ID NO: 2364) | DIQMTQSPSSLSASVGDRVTITCRASQSIVSYLNWYQQKPGKAPKLVIYAVTSRASGVPSRFSGSGSGTDFTLTISSLQPEDFATYYCQQSYDSPLTFGGGTKVEIK (SEQ ID NO: 2612) |
| 376_C12 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSANWHDTALDYWGQGTLVTVSS (SEQ ID NO: 2365) | DIQMTQSPSSLSASVGDRVTITCRASQSILTYVNWYQQKPGKAPKLLIYAATSRASGVPSRFSGSGSGTDFTLTISSLQPEDFATYYCQQSYDSPLTFGGGTKVEIK (SEQ ID NO: 2613) |
| 376_D05 | EVQLLESGGGLVQPGGSLRLSCAASGFTFSSYSMNWVRQAPGKGLEWVSNINYNGGYKGYADSVKGRFTISRDNSKNTLYLQMNSLRAEDTAVYYCARSANWHDTALDYWGQGTLVTVSS (SEQ ID NO: 2366) | DIQMTQSPSSLSASVGDRVTITCRASQSIVSYVNWYQQKPGKAPKLLIYAATSLASGVPSRFSGSGSGTDFTLTISSLQPEDFATYYCQQSYDTPLTFGGGTKVEIK (SEQ ID NO: 2614) |
| 376_D11 | EVQLLESGGGLVQPGGSLRLSCAASGFTFSSYGMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2367) | DIQMTQSPSSLSASVGDRVTITCRASQSILSYLNWYQQKPGKAPKLVIYAATSRASGVPSRFSGSGSGTDFTLTISSLQPEDFATYYCQQSYNNPLTFGGGTKVEIK (SEQ ID NO: 2615) |
| 376_E03 | EVQLLESGGGLVQPGGSLRLSCAASGFTFSSYGMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2368) | DIQMTQSPSSLSASVGDRVTITCRASQSILSYVNWYQQKPGKAPKLVIYAATSLASGVPSRFSGSGSGTDFTLTISSLQPEDFATYYCQQSYDLPLTFGGGTKVEIK (SEQ ID NO: 2616) |
| 376_E08 | EVQLLESGGGLVQPGGSLRLSCAASGFTFSDYGMNWVRQAPGKGLEWVAGINYNGGYTSYADSVKGRFTISRDNSKNTLYLQMNSLRAEDTAVYYCARSANWHDTALDYWGQGTLVTVSS (SEQ ID NO: 2369) | DIQMTQSPSSLSASVGDRVTITCRASQSIVSYVNWYQQKPGKAPKLVIYAATSRASGVPSRFSGSGSGTDFTLTISSLQPEDFATYYCQQSYDSPLTFGGGTKVEIK (SEQ ID NO: 2617) |
| 376_F03 | EVQLLESGGGLVQPGGSLRLSCAASGFTFDSYGMNWVRQAPGKGLEWVANINYNGGYTAYADSVKGRFTISRDNSKNTLYLQMNSLRAEDTAVYYCARSANWHDTALDYWGQGTLVTVSS (SEQ ID NO: 2370) | DIQMTQSPSSLSASVGDRVTITCRASQSIITYVNWYQQKPGKAPKLVIYATTSLASGVPSRFSGSGSGTDFTLTISSLQPEDFATYYCQQSYSSPLTFGGGTKVEIK (SEQ ID NO: 2618) |
| 376_F04 | EVQLLESGGGLVQPGGSLRLSCAASGFTFDSYSMNWVRQAPGKGLEWVSNINYNSGYTGYADSVKGRFTISRDNSKNTLYLQMNSLRAEDTAVYYCARSANWHDTALDYWGQGTLVTVSS (SEQ ID NO: 2371) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 2619) |
| 376_G08 | EVQLLESGGGLVQPGGSLRLSCAASGFTFDSYGMNWVRQAPGKGLEWVANINYNGGYTSYADSVKGRFTISRDNSKNTLYLQMNSLRAEDTAVYYCARSANWHDTALDYWGQGTLVTVSS (SEQ ID NO: 2372) | DIQMTQSPSSLSASVGDRVTITCRASQSILSYVNWYQQKPGKAPKLVIYAATSRASGVPSRFSGSGSGTDFTLTISSLQPEDFATYYCQQSYDTPLTFGGGTKVEIK (SEQ ID NO: 2620) |
| 376_G09 | EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSANWHDTALDYWGQGTLVTVSS (SEQ ID NO: 2373) | DIQMTQSPSSLSASVGDRVTITCRASQSISYYLNWYQQKPGKAPKLLIYAVTSRASGVPSRFSGSGSGTDFTLTISSLQPEDFATYYCQQSYDNPLTFGGGTKVEIK (SEQ ID NO: 2621) |
| 376_H09 | EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARSANWHDTALDYWGQGTLVTVSS (SEQ ID NO: 2374) | DIQMTQSPSSLSASVGDRVTITCRASQSIITYLNWYQQKPGKAPKLVIYYVSNLPSGVPSRFSGSGSGTDFTLTISSLQPEDFATYYCQQSYDSPLTFGGGTKVEIK (SEQ ID NO: 2622) |

TABLE 2E-continued

Group V Antibody Sequences

| Ab | VH sequence | VL sequence |
|---|---|---|
| 376_H10 | EVQLLESGGGLVQPGGSLRLSCAASGFT FDSYSMNWVRQAPGKGLEWVSGINYNSG YKSYADSVKGRFTISRDNSKNTLYLQMN SLRAEDTAVYYCARSANWHDTALDYWGQ GTLVTVSS (SEQ ID NO: 2375) | DIQMTQSPSSLSASVGDRVTITCRASQSILTYLN WYQQKPGKAPKLVIYAATSRHSGVPSRFSGSGSG TDFTLTISSLQPEDFATYYCQQSYDSPLTFGGGT KVEIK (SEQ ID NO: 2623) |

Table 3E provides the amino acid sequences of the CDRs of the antibodies shown in Table 2E.

TABLE 3E

CDR sequences for Group V antibodies

| Ab | HCDR1 | HCDR2 | HCDR3 | LCDR1 | LCDR2 | LCDR3 |
|---|---|---|---|---|---|---|
| 365_A03 | SSYSMN (SEQ ID NO: 2624) | WVAGINYNSGYKG (SEQ ID NO: 2872) | ARSANWHDTALD (SEQ ID NO: 3120) | LSYLNWY (SEQ ID NO: 3368) | LVIYAVTSRA (SEQ ID NO: 3616) | QQSYDSPL (SEQ ID NO: 3864) |
| 365_A11 | DDYGMN (SEQ ID NO: 2625) | WVSGINYNSGYTS (SEQ ID NO: 2873) | ARSANWHDTALD (SEQ ID NO: 3121) | LSYLNWY (SEQ ID NO: 3369) | LVIYAATSLA (SEQ ID NO: 3617) | QQSYESPL (SEQ ID NO: 3865) |
| 365_A12 | SSYGMH (SEQ ID NO: 2626) | WVAGINYNGGYTS (SEQ ID NO: 2874) | AKSANWHDTHLD (SEQ ID NO: 3122) | LTYVNWY (SEQ ID NO: 3370) | LLIYAATSRH (SEQ ID NO: 3618) | QQSYENPL (SEQ ID NO: 3866) |
| 365_B01 | DSYGMH (SEQ ID NO: 2627) | WVASINYNSGYTS (SEQ ID NO: 2875) | ARSANWHDTALD (SEQ ID NO: 3123) | SSYVNWY (SEQ ID NO: 3371) | LVIYAATSRA (SEQ ID NO: 3619) | QQSYESPL (SEQ ID NO: 3867) |
| 365_B06 | DSYGMH (SEQ ID NO: 2628) | WVSNINYNGGYKS (SEQ ID NO: 2876) | ARSANWHDTALD (SEQ ID NO: 3124) | LTYVNWY (SEQ ID NO: 3372) | LLIYATTSLA (SEQ ID NO: 3620) | QQSYDLPL (SEQ ID NO: 3868) |
| 365_B07 | SSYGMH (SEQ ID NO: 2629) | WVASINYNSGYTS (SEQ ID NO: 2877) | ARSANWHDTALD (SEQ ID NO: 3125) | LTYLNWY (SEQ ID NO: 3373) | LLIYAATSRA (SEQ ID NO: 3621) | QQSYENPL (SEQ ID NO: 3869) |
| 365_B11 | SSYGMH (SEQ ID NO: 2630) | WVAGINYNGGYTS (SEQ ID NO: 2878) | ARSANWHDTALD (SEQ ID NO: 3126) | ISYLNWY (SEQ ID NO: 3374) | LVIYATTSRH (SEQ ID NO: 3622) | QQSYDSPL (SEQ ID NO: 3870) |
| 365_C01 | DSYGMN (SEQ ID NO: 2631) | WVSSINYNSGYKS (SEQ ID NO: 2879) | ARSANWHDTHLD (SEQ ID NO: 3127) | VSYLNWY (SEQ ID NO: 3375) | LVIYAVTSRA (SEQ ID NO: 3623) | QQSYESPL (SEQ ID NO: 3871) |
| 365_C10 | SSYGMH (SEQ ID NO: 2632) | WVASINYNGGYTS (SEQ ID NO: 2880) | ARSANWHDTALD (SEQ ID NO: 3128) | LSYVNWY (SEQ ID NO: 3376) | LLIYAATSLA (SEQ ID NO: 3624) | QQSYESPL (SEQ ID NO: 3872) |
| 365_C11 | SSYSMN (SEQ ID NO: 2633) | WVAGINYNGGYKS (SEQ ID NO: 2881) | ARSANWHDTHLD (SEQ ID NO: 3129) | ITYLNWY (SEQ ID NO: 3377) | LVIYAVTSRA (SEQ ID NO: 3625) | QQSYSLPL (SEQ ID NO: 3873) |
| 365_C12 | SSYGMN (SEQ ID NO: 2634) | WVAGINYNSGYKS (SEQ ID NO: 2882) | ARSANWHDTALD (SEQ ID NO: 3130) | VSYVNWY (SEQ ID NO: 3378) | LVIYAVTSLA (SEQ ID NO: 3626) | QQSYDTPL (SEQ ID NO: 3874) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 365_D09 | SSYGMH (SEQ ID NO: 2635) | WVSGINYNSGYTS (SEQ ID NO: 2883) | ARSANWHDTALD (SEQ ID NO: 3131) | LSYLNWY (SEQ ID NO: 3379) | LLIYAATSRA (SEQ ID NO: 3627) | QQSDESPL (SEQ ID NO: 3875) |
| 365_D11 | DSYGMN (SEQ ID NO: 2636) | WVSNINYNSGYTS (SEQ ID NO: 2884) | ARSANWHDTALD (SEQ ID NO: 3132) | VSYLNWY (SEQ ID NO: 3380) | LVIYAATSRA (SEQ ID NO: 3628) | QQSYSSPL (SEQ ID NO: 3876) |
| 365_D12 | DSYGMN (SEQ ID NO: 2637) | WVSNINYNGGYTG (SEQ ID NO: 2885) | ARSANWHDTALD (SEQ ID NO: 3133) | VTYLNWY (SEQ ID NO: 3381) | LVIYAATSRA (SEQ ID NO: 3629) | QQSYDTPL (SEQ ID NO: 3877) |
| 365_E01 | SDYSMN (SEQ ID NO: 2638) | WVSGINYNSGYKG (SEQ ID NO: 2886) | ARSANWHDTALD (SEQ ID NO: 3134) | ISYLNWY (SEQ ID NO: 3382) | LLIYAATSRA (SEQ ID NO: 3630) | QQSYDSPL (SEQ ID NO: 3878) |
| 365_E05 | SSYGMH (SEQ ID NO: 2639) | WVAGINYNGGYTS (SEQ ID NO: 2887) | ARSANWHDTALD (SEQ ID NO: 3135) | VSYVNWY (SEQ ID NO: 3383) | LLIYAATSLA (SEQ ID NO: 3631) | QQSYDNPL (SEQ ID NO: 3879) |
| 365_E07 | DSYGMH (SEQ ID NO: 2640) | WVSGINYNSGYTS (SEQ ID NO: 2888) | AKSANWHDTHLD (SEQ ID NO: 3136) | LSYLNWY (SEQ ID NO: 3384) | LLIYAATSRA (SEQ ID NO: 3632) | QQSYDNPL (SEQ ID NO: 3880) |
| 365_E09 | SSYGMH (SEQ ID NO: 2641) | WVASINYNSGYKS (SEQ ID NO: 2889) | ARSANWHDTALD (SEQ ID NO: 3137) | LTYVNWY (SEQ ID NO: 3385) | LVIYAATSRA (SEQ ID NO: 3633) | QQSDDSPL (SEQ ID NO: 3881) |
| 365_F01 | DSYSMN (SEQ ID NO: 2642) | WVSGINYNSGYKG (SEQ ID NO: 2890) | ARSANWHDTHLD (SEQ ID NO: 3138) | VSYLNWY (SEQ ID NO: 3386) | LVIYAATSLA (SEQ ID NO: 3634) | QQSYELPL (SEQ ID NO: 3882) |
| 365_F06 | SSYGMN (SEQ ID NO: 2643) | WVAGINYNSGYKS (SEQ ID NO: 2891) | ARSANWHDTALD (SEQ ID NO: 3139) | LSYVNWY (SEQ ID NO: 3387) | LLIYAATSRA (SEQ ID NO: 3635) | QQSDNLPL (SEQ ID NO: 3883) |
| 365_F12 | SDYSMN (SEQ ID NO: 2644) | WVSGINYNGGYTS (SEQ ID NO: 2892) | ARSANWHDTHLD (SEQ ID NO: 3140) | LTYVNWY (SEQ ID NO: 3388) | LVIYAATSRH (SEQ ID NO: 3636) | QQSYETPL (SEQ ID NO: 3884) |
| 365_G01 | DSYGMN (SEQ ID NO: 2645) | WVAGINYNSGYKS (SEQ ID NO: 2893) | ARSANWHDTALD (SEQ ID NO: 3141) | LTYVNWY (SEQ ID NO: 3389) | LLIYATTSRA (SEQ ID NO: 3637) | QQSYDSPL (SEQ ID NO: 3885) |
| 365_G11 | SSYGMN (SEQ ID NO: 2646) | WVANINYNGGYTG (SEQ ID NO: 2894) | ARSANWHDTALD (SEQ ID NO: 3142) | ITYVNWY (SEQ ID NO: 3390) | LLIYAVTSRH (SEQ ID NO: 3638) | QQSYNSPL (SEQ ID NO: 3886) |
| 365_H02 | SDYGMN (SEQ ID NO: 2647) | WVSSINYNGGYTG (SEQ ID NO: 2895) | ARSANWHDTHLD (SEQ ID NO: 3143) | LTYLNWY (SEQ ID NO: 3391) | LLIYAATSRA (SEQ ID NO: 3639) | QQSYENPL (SEQ ID NO: 3887) |
| 365_H03 | DDYGMN (SEQ ID NO: 2648) | WVAGINYNGGYKS (SEQ ID NO: 2896) | ARSANWHDTALD (SEQ ID NO: 3144) | LSYVNWY (SEQ ID NO: 3392) | LVIYAATSLH (SEQ ID NO: 3640) | QQSYNNPL (SEQ ID NO: 3888) |
| 365_H06 | SSYGMN (SEQ ID NO: 2649) | WVSGINYNSGYTG (SEQ ID NO: 2897) | ARSANWHDTALD (SEQ ID NO: 3145) | SSYVNWY (SEQ ID NO: 3393) | LLIYAATSRA (SEQ ID NO: 3641) | QQSYSTPL (SEQ ID NO: 3889) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 365_H10 | DSYGMN (SEQ ID NO: 2650) | WVAGINYNSGYKS (SEQ ID NO: 2898) | ARSANWHDTHLD (SEQ ID NO: 3146) | VTYVNWY (SEQ ID NO: 3394) | LVIYAATSLA (SEQ ID NO: 3642) | QQSYNTPL (SEQ ID NO: 3890) |
| 365_H11 | SSYSMN (SEQ ID NO: 2651) | WVSGINYNSGYTG (SEQ ID NO: 2899) | ARSANWHDTALD (SEQ ID NO: 3147) | LTYLNWY (SEQ ID NO: 3395) | LLIYAATSRA (SEQ ID NO: 3643) | QQSYDSPL (SEQ ID NO: 3891) |
| 365_H12 | SSYSMN (SEQ ID NO: 2652) | WVSNINYNGGYKS (SEQ ID NO: 2900) | ARSANWHDTHLD (SEQ ID NO: 3148) | ITYVNWY (SEQ ID NO: 3396) | LLIYAATSRA (SEQ ID NO: 3644) | QQSYSTPL (SEQ ID NO: 3892) |
| 366_A07 | SSYGMH (SEQ ID NO: 2653) | WVASINYNGGYTG (SEQ ID NO: 2901) | ARSANWHDTALD (SEQ ID NO: 3149) | VSYVNWY (SEQ ID NO: 3397) | LVIYAATSRH (SEQ ID NO: 3645) | QQSYESPL (SEQ ID NO: 3893) |
| 366_B08 | DSYGMN (SEQ ID NO: 2654) | WVSNINYNGGYKG (SEQ ID NO: 2902) | ARSANWHDTHLD (SEQ ID NO: 3150) | VSYLNWY (SEQ ID NO: 3398) | LLIYAATSRH (SEQ ID NO: 3646) | QQSYDNPL (SEQ ID NO: 3894) |
| 366_B10 | SSYGMN (SEQ ID NO: 2655) | WVSGINYNSGYTS (SEQ ID NO: 2903) | ARSANWHDTALD (SEQ ID NO: 3151) | ISYLNWY (SEQ ID NO: 3399) | LLIYAATSRA (SEQ ID NO: 3647) | QQSYDNPL (SEQ ID NO: 3895) |
| 366_B12 | SSYSMN (SEQ ID NO: 2656) | WVAGINYNSGYKG (SEQ ID NO: 2904) | ARSANWHDTALD (SEQ ID NO: 3152) | LTYVNWY (SEQ ID NO: 3400) | LLIYAATSRA (SEQ ID NO: 3648) | QQSYDNPL (SEQ ID NO: 3896) |
| 366_D04 | SSYSMN (SEQ ID NO: 2657) | WVSGINYNGGYTS (SEQ ID NO: 2905) | ARSANWHDTALD (SEQ ID NO: 3153) | SSYVNWY (SEQ ID NO: 3401) | LLIYATTSRA (SEQ ID NO: 3649) | QQSYETPL (SEQ ID NO: 3897) |
| 366_E10 | DSYGMN (SEQ ID NO: 2658) | WVSGINYNGGYKG (SEQ ID NO: 2906) | ARSANWHDTHLD (SEQ ID NO: 3154) | LSYVNWY (SEQ ID NO: 3402) | LVIYAATSRH (SEQ ID NO: 3650) | QQSYSLPL (SEQ ID NO: 3898) |
| 366_F04 | SDYGMN (SEQ ID NO: 2659) | WVSGINYNGGYTS (SEQ ID NO: 2907) | ARSANWHDTALD (SEQ ID NO: 3155) | LSYVNWY (SEQ ID NO: 3403) | LVIYATTSRH (SEQ ID NO: 3651) | QQSYESPL (SEQ ID NO: 3899) |
| 366_F05 | SSYSMN (SEQ ID NO: 2660) | WVANINYNSGYKS (SEQ ID NO: 2908) | ARSANWHDTHLD (SEQ ID NO: 3156) | LTYLNWY (SEQ ID NO: 3404) | LLIYAATSRA (SEQ ID NO: 3652) | QQSDNTPL (SEQ ID NO: 3900) |
| 366_F07 | SDYSMN (SEQ ID NO: 2661) | WVAGINYNSGYTS (SEQ ID NO: 2909) | ARSANWHDTHLD (SEQ ID NO: 3157) | ITYLNWY (SEQ ID NO: 3405) | LLIYAATSRA (SEQ ID NO: 3653) | QQSYETPL (SEQ ID NO: 3901) |
| 366_G04 | SSYSMN (SEQ ID NO: 2662) | WVSGINYNSGYTS (SEQ ID NO: 2910) | ARSANWHDTALD (SEQ ID NO: 3158) | ITYLNWY (SEQ ID NO: 3406) | LLIYAATSRA (SEQ ID NO: 3654) | QQSDDTPL (SEQ ID NO: 3902) |
| 366_G05 | DSYGMN (SEQ ID NO: 2663) | WVSNINYNGGYTS (SEQ ID NO: 2911) | ARSANWHDTALD (SEQ ID NO: 3159) | ISYVNWY (SEQ ID NO: 3407) | LVIYAATSRA (SEQ ID NO: 3655) | QQSYENPL (SEQ ID NO: 3903) |
| 366_H06 | SSYGMN (SEQ ID NO: 2664) | WVSSINYNGGYTG (SEQ ID NO: 2912) | ARSANWHDTALD (SEQ ID NO: 3160) | LSYLNWY (SEQ ID NO: 3408) | LLIYATTSRA (SEQ ID NO: 3656) | QQSYDTPL (SEQ ID NO: 3904) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 366_H07 | SSYGMH (SEQ ID NO: 2665) | WVSGINYNGGYTS (SEQ ID NO: 2913) | ARSANWHDTALD (SEQ ID NO: 3161) | ISYVNWY (SEQ ID NO: 3409) | LVIYAVTSRA (SEQ ID NO: 3657) | QQSYENPL (SEQ ID NO: 3905) |
| 366_H08 | SDYGMN (SEQ ID NO: 2666) | WVASINYNSGYTS (SEQ ID NO: 2914) | ARSANWHDTHLD (SEQ ID NO: 3162) | LSYVNWY (SEQ ID NO: 3410) | LLIYAATSRH (SEQ ID NO: 3658) | QQSYNNPL (SEQ ID NO: 3906) |
| 366_H09 | DSYGMN (SEQ ID NO: 2667) | WVSNINYNSGYKG (SEQ ID NO: 2915) | ARSANWHDTALD (SEQ ID NO: 3163) | VSYVNWY (SEQ ID NO: 3411) | LVIYATTSRA (SEQ ID NO: 3659) | QQSYSSPL (SEQ ID NO: 3907) |
| 367_A04 | SSYSMN (SEQ ID NO: 2668) | WVSNINYNSGYKS (SEQ ID NO: 2916) | ARSANWHDTALD (SEQ ID NO: 3164) | ITYLNWY (SEQ ID NO: 3412) | LLIYAATSRA (SEQ ID NO: 3660) | QQSDDSPL (SEQ ID NO: 3908) |
| 367_A05 | SDYGMN (SEQ ID NO: 2669) | WVSSINYNGGYKG (SEQ ID NO: 2917) | ARSANWHDTALD (SEQ ID NO: 3165) | LSYLNWY (SEQ ID NO: 3413) | LVIYAVTSRA (SEQ ID NO: 3661) | QQSYDSPL (SEQ ID NO: 3909) |
| 367_B02 | DSYGMN (SEQ ID NO: 2670) | WVSSINYNGGYTS (SEQ ID NO: 2918) | ARSANWHDTALD (SEQ ID NO: 3166) | VTYLNWY (SEQ ID NO: 3414) | LLIYAASSLQ (SEQ ID NO: 3662) | QQSYSTPL (SEQ ID NO: 3910) |
| 367_B03 | SSYGMN (SEQ ID NO: 2671) | WVAGINYNGGYKS (SEQ ID NO: 2919) | ARSANWHDTALD (SEQ ID NO: 3167) | LTYLNWY (SEQ ID NO: 3415) | LLIYAATSLA (SEQ ID NO: 3663) | QQSYNLPL (SEQ ID NO: 3911) |
| 367_B07 | SDYSMN (SEQ ID NO: 2672) | WVAGINYNSGYTG (SEQ ID NO: 2920) | ARSANWHDTHLD (SEQ ID NO: 3168) | ISYVNWY (SEQ ID NO: 3416) | LLIYAATSLA (SEQ ID NO: 3664) | QQSYNLPL (SEQ ID NO: 3912) |
| 367_B08 | SDYGMN (SEQ ID NO: 2673) | WVSGINYNGGYKG (SEQ ID NO: 2921) | ARSANWHDTALD (SEQ ID NO: 3169) | LTYLNWY (SEQ ID NO: 3417) | LVIYAATSRA (SEQ ID NO: 3665) | QQSYDNPL (SEQ ID NO: 3913) |
| 367_C01 | DDYSMN (SEQ ID NO: 2674) | WVSGINYNGGYKS (SEQ ID NO: 2922) | ARSANWHDTHLD (SEQ ID NO: 3170) | LTYLNWY (SEQ ID NO: 3418) | LVIYATTSLH (SEQ ID NO: 3666) | QQSYDTPL (SEQ ID NO: 3914) |
| 367_C05 | DDYGMN (SEQ ID NO: 2675) | WVSSINYNGGYTG (SEQ ID NO: 2923) | ARSANWHDTHLD (SEQ ID NO: 3171) | LSYVNWY (SEQ ID NO: 3419) | LVIYAATSRH (SEQ ID NO: 3667) | QQSYDLPL (SEQ ID NO: 3915) |
| 367_C11 | DSYSMN (SEQ ID NO: 2676) | WVSSINYNSGYTG (SEQ ID NO: 2924) | ARSANWHDTHLD (SEQ ID NO: 3172) | LSYLNWY (SEQ ID NO: 3420) | LVIYAATSRH (SEQ ID NO: 3668) | QQSYNTPL (SEQ ID NO: 3916) |
| 367_D10 | DSYGMN (SEQ ID NO: 2677) | WVSNINYNGGYTS (SEQ ID NO: 2925) | ARSANWHDTALD (SEQ ID NO: 3173) | ISYLNWY (SEQ ID NO: 3421) | LVIYAATSRA (SEQ ID NO: 3669) | QQSYDTPL (SEQ ID NO: 3917) |
| 367_E01 | SSYGMN (SEQ ID NO: 2678) | WVAGINYNGGYKS (SEQ ID NO: 2926) | ARSANWHDTALD (SEQ ID NO: 3174) | LSYVNWY (SEQ ID NO: 3422) | LLIYATTSRA (SEQ ID NO: 3670) | QQSYDLPL (SEQ ID NO: 3918) |
| 367_E04 | SDYSMN (SEQ ID NO: 2679) | WVSSINYNGGYKG (SEQ ID NO: 2927) | ARSANWHDTHLD (SEQ ID NO: 3175) | LSYLNWY (SEQ ID NO: 3423) | LLIYAATSRA (SEQ ID NO: 3671) | QQSYESPL (SEQ ID NO: 3919) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 367_E06 | DSYSMN (SEQ ID NO: 2680) | WVSSINYNSGYKG (SEQ ID NO: 2928) | ARSANWHDTHLD (SEQ ID NO: 3176) | SSYLNWY (SEQ ID NO: 3424) | LLIYAASSLQ (SEQ ID NO: 3672) | QQSYSTPL (SEQ ID NO: 3920) |
| 367_E09 | SDYGMN (SEQ ID NO: 2681) | WVASINYNSGYKG (SEQ ID NO: 2929) | ARSANWHDTALD (SEQ ID NO: 3177) | LSYLNWY (SEQ ID NO: 3425) | LVIYATTSRA (SEQ ID NO: 3673) | QQSYETPL (SEQ ID NO: 3921) |
| 367_E11 | DSYGMN (SEQ ID NO: 2682) | WVSSINYNSGYKG (SEQ ID NO: 2930) | ARSANWHDTHLD (SEQ ID NO: 3178) | VSYVNWY (SEQ ID NO: 3426) | LVIYAATSRH (SEQ ID NO: 3674) | QQSYDTPL (SEQ ID NO: 3922) |
| 367_F03 | SSYSMN (SEQ ID NO: 2683) | WVAGINYNSGYKS (SEQ ID NO: 2931) | ARSANWHDTALD (SEQ ID NO: 3179) | LSYVNWY (SEQ ID NO: 3427) | LVIYAATSLA (SEQ ID NO: 3675) | QQSDDTPL (SEQ ID NO: 3923) |
| 367_F07 | DSYGMH (SEQ ID NO: 2684) | WVANINYNGGYTG (SEQ ID NO: 2932) | ARSANWHDTALD (SEQ ID NO: 3180) | ISYVNWY (SEQ ID NO: 3428) | LLIYAATSRA (SEQ ID NO: 3676) | QQSYETPL (SEQ ID NO: 3924) |
| 367_F11 | SSYSMN (SEQ ID NO: 2685) | WVAGINYNSGYTG (SEQ ID NO: 2933) | ARSANWHDTHLD (SEQ ID NO: 3181) | SSYLNWY (SEQ ID NO: 3429) | LLIYAASSLQ (SEQ ID NO: 3677) | QQSYSTPL (SEQ ID NO: 3925) |
| 367_G05 | SDYGMN (SEQ ID NO: 2686) | WVANINYNGGYTS (SEQ ID NO: 2934) | ARSANWHDTALD (SEQ ID NO: 3182) | VSYLNWY (SEQ ID NO: 3430) | LVIYAATSLA (SEQ ID NO: 3678) | QQSYDTPL (SEQ ID NO: 3926) |
| 367_G06 | SSYGMN (SEQ ID NO: 2687) | WVSGINYNSGYKS (SEQ ID NO: 2935) | ARSANWHDTHLD (SEQ ID NO: 3183) | LTYVNWY (SEQ ID NO: 3431) | LLIYATTSLH (SEQ ID NO: 3679) | QQSYDTPL (SEQ ID NO: 3927) |
| 367_G10 | DDYGMN (SEQ ID NO: 2688) | WVSGINYNGGYTS (SEQ ID NO: 2936) | ARSANWHDTALD (SEQ ID NO: 3184) | ISYVNWY (SEQ ID NO: 3432) | LLIYAATSRA (SEQ ID NO: 3680) | QQSYDSPL (SEQ ID NO: 3928) |
| 367_H06 | SSYGMN (SEQ ID NO: 2689) | WVSNINYNGGYTG (SEQ ID NO: 2937) | ARSANWHDTHLD (SEQ ID NO: 3185) | ITYLNWY (SEQ ID NO: 3433) | LLIYAATSRA (SEQ ID NO: 3681) | QQSYDTPL (SEQ ID NO: 3929) |
| 367_H11 | SSYGMN (SEQ ID NO: 2690) | WVAGINYNGGYKG (SEQ ID NO: 2938) | ARSANWHDTALD (SEQ ID NO: 3186) | ISYVNWY (SEQ ID NO: 3434) | LVIYAATSRA (SEQ ID NO: 3682) | QQSYNSPL (SEQ ID NO: 3930) |
| 368_A01 | SSYGMN (SEQ ID NO: 2691) | WVSNINYNGGYTS (SEQ ID NO: 2939) | ARSANWHDTALD (SEQ ID NO: 3187) | ISYLNWY (SEQ ID NO: 3435) | LLIYAATSRH (SEQ ID NO: 3683) | QQSYDNPL (SEQ ID NO: 3931) |
| 368_A05 | SSYSMN (SEQ ID NO: 2692) | WVAGINYNSGYTG (SEQ ID NO: 2940) | ARSANWHDTALD (SEQ ID NO: 3188) | VSYLNWY (SEQ ID NO: 3436) | LVIYAATSRA (SEQ ID NO: 3684) | QQSYDSPL (SEQ ID NO: 3932) |
| 368_A07 | SSYSMN (SEQ ID NO: 2693) | WVAGINYNSGYTS (SEQ ID NO: 2941) | ARSANWHDTHLD (SEQ ID NO: 3189) | LTYLNWY (SEQ ID NO: 3437) | LVIYATTSRA (SEQ ID NO: 3685) | QQSNELPL (SEQ ID NO: 3933) |
| 368_A09 | DSYSMN (SEQ ID NO: 2694) | WVSGINYNGGYTS (SEQ ID NO: 2942) | ARSANWHDTHLD (SEQ ID NO: 3190) | LSYVNWY (SEQ ID NO: 3438) | LLIYAVTSRA (SEQ ID NO: 3686) | QQSYDSPL (SEQ ID NO: 3934) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 368_B01 | SSYGMN (SEQ ID NO: 2695) | WVSGINYNSGYKS (SEQ ID NO: 2943) | ARSANWHDTALD (SEQ ID NO: 3191) | SSYLNWY (SEQ ID NO: 3439) | LLIYAATSRA (SEQ ID NO: 3687) | QQSYETPL (SEQ ID NO: 3935) |
| 368_B06 | DSYGMH (SEQ ID NO: 2696) | WVSGINYNSGYTS (SEQ ID NO: 2944) | ARSANWHDTALD (SEQ ID NO: 3192) | ISYLNWY (SEQ ID NO: 3440) | LLIYAASSLQ (SEQ ID NO: 3688) | QQSYSTPL (SEQ ID NO: 3936) |
| 368_B07 | SDYSMN (SEQ ID NO: 2697) | WVSNINYNGGYKS (SEQ ID NO: 2945) | ARSANWHDTALD (SEQ ID NO: 3193) | VSYLNWY (SEQ ID NO: 3441) | LLIYAATSLA (SEQ ID NO: 3689) | QQSYSSPL (SEQ ID NO: 3937) |
| 368_C05 | DSYGMN (SEQ ID NO: 2698) | WVSGINYNSGYTS (SEQ ID NO: 2946) | ARSANWHDTALD (SEQ ID NO: 3194) | LSYLNWY (SEQ ID NO: 3442) | LVIYAATSRA (SEQ ID NO: 3690) | QQSDSNPL (SEQ ID NO: 3938) |
| 368_D01 | SSYGMH (SEQ ID NO: 2699) | WVANINYNGGYTS (SEQ ID NO: 2947) | ARSANWHDTALD (SEQ ID NO: 3195) | LSYLNWY (SEQ ID NO: 3443) | LVIYAATSRA (SEQ ID NO: 3691) | QQSDSTPL (SEQ ID NO: 3939) |
| 368_D04 | SSYGMN (SEQ ID NO: 2700) | WVSGINYNGGYKS (SEQ ID NO: 2948) | ARSANWHDTALD (SEQ ID NO: 3196) | STYVNWY (SEQ ID NO: 3444) | LVIYAVTSRH (SEQ ID NO: 3692) | QQSYDSPL (SEQ ID NO: 3940) |
| 368_D05 | SSYSMN (SEQ ID NO: 2701) | WVSGINYNGGYTS (SEQ ID NO: 2949) | ARSANWHDTALD (SEQ ID NO: 3197) | LTYLNWY (SEQ ID NO: 3445) | LVIYAATSRA (SEQ ID NO: 3693) | QQSDDSPL (SEQ ID NO: 3941) |
| 368_D11 | DDYGMN (SEQ ID NO: 2702) | WVSNINYNGGYKS (SEQ ID NO: 2950) | ARSANWHDTALD (SEQ ID NO: 3198) | LTYLNWY (SEQ ID NO: 3446) | LVIYAATSRA (SEQ ID NO: 3694) | QQSYDLPL (SEQ ID NO: 3942) |
| 368_E01 | SSYSMN (SEQ ID NO: 2703) | WVASINYNSGYTG (SEQ ID NO: 2951) | ARSANWHDTHLD (SEQ ID NO: 3199) | LSYLNWY (SEQ ID NO: 3447) | LLIYAVTSRH (SEQ ID NO: 3695) | QQSYSLPL (SEQ ID NO: 3943) |
| 368_E02 | DSYSMN (SEQ ID NO: 2704) | WVAGINYNSGYTS (SEQ ID NO: 2952) | ARSANWHDTHLD (SEQ ID NO: 3200) | LTYLNWY (SEQ ID NO: 3448) | LLIYAATSRA (SEQ ID NO: 3696) | QQSYSSPL (SEQ ID NO: 3944) |
| 368_E04 | SSYSMN (SEQ ID NO: 2705) | WVANINYNSGYTG (SEQ ID NO: 2953) | ARSANWHDTALD (SEQ ID NO: 3201) | LSYVNWY (SEQ ID NO: 3449) | LLIYAATSRH (SEQ ID NO: 3697) | QQSYDNPL (SEQ ID NO: 3945) |
| 368_E06 | SDYGMH (SEQ ID NO: 2706) | WVSGINYNGGYTG (SEQ ID NO: 2954) | ARSANWHDTALD (SEQ ID NO: 3202) | LSYLNWY (SEQ ID NO: 3450) | LVIYGATSRA (SEQ ID NO: 3698) | QQSYDSPL (SEQ ID NO: 3946) |
| 368_E07 | SSYGMN (SEQ ID NO: 2707) | WVAGINYNGGYTS (SEQ ID NO: 2955) | AKSANWHDTALD (SEQ ID NO: 3203) | LSYLNWY (SEQ ID NO: 3451) | LLIYAVTSRA (SEQ ID NO: 3699) | QQSYENPL (SEQ ID NO: 3947) |
| 368_F03 | DSYSMN (SEQ ID NO: 2708) | WVAGINYNSGYTG (SEQ ID NO: 2956) | AKSANWHDTALD (SEQ ID NO: 3204) | ISYLNWY (SEQ ID NO: 3452) | LVIYAATSRH (SEQ ID NO: 3700) | QQSYDSPL (SEQ ID NO: 3948) |
| 368_F11 | SDYGMN (SEQ ID NO: 2709) | WVSGINYNGGYTS (SEQ ID NO: 2957) | ARSANWHDTHLD (SEQ ID NO: 3205) | VSYVNWY (SEQ ID NO: 3453) | LVIYAATSRA (SEQ ID NO: 3701) | QQSYNNPL (SEQ ID NO: 3949) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 368_G01 | SDYGMH (SEQ ID NO: 2710) | WVASINYNSGYTS (SEQ ID NO: 2958) | ARSANWHDTALD (SEQ ID NO: 3206) | LTYLNWY (SEQ ID NO: 3454) | LVIYAATSRA (SEQ ID NO: 3702) | QQSYNLPL (SEQ ID NO: 3950) |
| 368_G12 | SSYGMN (SEQ ID NO: 2711) | WVASINYNSGYTG (SEQ ID NO: 2959) | ARSANWHDTALD (SEQ ID NO: 3207) | SSYVNWY (SEQ ID NO: 3455) | LVIYAVTSRA (SEQ ID NO: 3703) | QQSYETPL (SEQ ID NO: 3951) |
| 368_H04 | SSYSMN (SEQ ID NO: 2712) | WVAGINYNSGYKG (SEQ ID NO: 2960) | AKSANWHDTHLD (SEQ ID NO: 3208) | VSYVNWY (SEQ ID NO: 3456) | LLIYAATSRA (SEQ ID NO: 3704) | QQSYDSPL (SEQ ID NO: 3952) |
| 369_A02 | SSYSMN (SEQ ID NO: 2713) | WVAGINYNSGYTG (SEQ ID NO: 2961) | ARSANWHDTHLD (SEQ ID NO: 3209) | LSYVNWY (SEQ ID NO: 3457) | LLIYAATSRA (SEQ ID NO: 3705) | QQSYDLPL (SEQ ID NO: 3953) |
| 369_A03 | SSYGMN (SEQ ID NO: 2714) | WVSNINYNGGYTG (SEQ ID NO: 2962) | ARSANWHDTALD (SEQ ID NO: 3210) | LTYLNWY (SEQ ID NO: 3458) | LLIYAVTSRH (SEQ ID NO: 3706) | QQGYDLPL (SEQ ID NO: 3954) |
| 369_B01 | SSYSMN (SEQ ID NO: 2715) | WVSGINYNGGYTS (SEQ ID NO: 2963) | ARSANWHDTALD (SEQ ID NO: 3211) | LSYLNWY (SEQ ID NO: 3459) | LLIYAVTSRA (SEQ ID NO: 3707) | QQSYENPL (SEQ ID NO: 3955) |
| 369_C02 | DSYSMN (SEQ ID NO: 2716) | WVSNINYNGGYKS (SEQ ID NO: 2964) | ARSANWHDTALD (SEQ ID NO: 3212) | LTYLNWY (SEQ ID NO: 3460) | LVIYAATSRA (SEQ ID NO: 3708) | QQSYELPL (SEQ ID NO: 3956) |
| 369_C03 | SSYGMN (SEQ ID NO: 2717) | WVSNINYNGGYKS (SEQ ID NO: 2965) | ARSANWHDTALD (SEQ ID NO: 3213) | LTYLNWY (SEQ ID NO: 3461) | LVIYAATSRA (SEQ ID NO: 3709) | QQSYDSPL (SEQ ID NO: 3957) |
| 369_C04 | SSYSMN (SEQ ID NO: 2718) | WVSNINYNGGYTG (SEQ ID NO: 2966) | ARSANWHDTALD (SEQ ID NO: 3214) | LTYVNWY (SEQ ID NO: 3462) | LLIYTTTSLH (SEQ ID NO: 3710) | QQSYNNPL (SEQ ID NO: 3958) |
| 369_D01 | SDYGMN (SEQ ID NO: 2719) | WVASINYNGGYTG (SEQ ID NO: 2967) | ARSANWHDTALD (SEQ ID NO: 3215) | LTYLNWY (SEQ ID NO: 3463) | LLIYAATSRA (SEQ ID NO: 3711) | QQSYSNPL (SEQ ID NO: 3959) |
| 369_D02 | SDYSMN (SEQ ID NO: 2720) | WVSNINYNSGYTG (SEQ ID NO: 2968) | ARSANWHDTALD (SEQ ID NO: 3216) | LSYLNWY (SEQ ID NO: 3464) | LVIYAVTSRA (SEQ ID NO: 3712) | QQSYDTPL (SEQ ID NO: 3960) |
| 369_D04 | DSYGMN (SEQ ID NO: 2721) | WVSGINYNGGYTS (SEQ ID NO: 2969) | ARSANWHDTALD (SEQ ID NO: 3217) | LSYVNWY (SEQ ID NO: 3465) | LVIYAATSRA (SEQ ID NO: 3713) | QQSYNLPL (SEQ ID NO: 3961) |
| 369_D12 | DSYSMN (SEQ ID NO: 2722) | WVAGINYNSGYTS (SEQ ID NO: 2970) | ARSANWHDTALD (SEQ ID NO: 3218) | LSYLNWY (SEQ ID NO: 3466) | LLIYAATSLA (SEQ ID NO: 3714) | QQSYDTPL (SEQ ID NO: 3962) |
| 369_E02 | DSYGMN (SEQ ID NO: 2723) | WVSNINYNGGYTG (SEQ ID NO: 2971) | ARSANWHDTALD (SEQ ID NO: 3219) | VSYVNWY (SEQ ID NO: 3467) | LLIYATTSRH (SEQ ID NO: 3715) | QQSYDNPL (SEQ ID NO: 3963) |
| 369_E11 | SSYGMN (SEQ ID NO: 2724) | WVSNINYNGGYTS (SEQ ID NO: 2972) | ARSANWHDTALD (SEQ ID NO: 3220) | ISYLNWY (SEQ ID NO: 3468) | LLIYAATSLA (SEQ ID NO: 3716) | QQSYDTPL (SEQ ID NO: 3964) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 369_E12 | SSYGMH (SEQ ID NO: 2725) | WVASINYNSGYTS (SEQ ID NO: 2973) | ARSANWHDTALD (SEQ ID NO: 3221) | ISYLNWY (SEQ ID NO: 3469) | LLIYAATSRA (SEQ ID NO: 3717) | QQSYESPL (SEQ ID NO: 3965) |
| 369_F01 | SSYGMN (SEQ ID NO: 2726) | WVSGINYNGGYKS (SEQ ID NO: 2974) | ARSANWHDTALD (SEQ ID NO: 3222) | LTYVNWY (SEQ ID NO: 3470) | LLIYAATSRA (SEQ ID NO: 3718) | QQSYELPL (SEQ ID NO: 3966) |
| 369_F02 | SSYGMN (SEQ ID NO: 2727) | WVASINYNSGYKS (SEQ ID NO: 2975) | ARSANWHDTALD (SEQ ID NO: 3223) | VSYLNWY (SEQ ID NO: 3471) | LVIYAATSRA (SEQ ID NO: 3719) | QQSYDTPL (SEQ ID NO: 3967) |
| 369_F03 | SDYGMN (SEQ ID NO: 2728) | WVSGINYNSGYTS (SEQ ID NO: 2976) | ARSANWHDTALD (SEQ ID NO: 3224) | VSYVNWY (SEQ ID NO: 3472) | LLIYAATSLA (SEQ ID NO: 3720) | QQSYDSPL (SEQ ID NO: 3968) |
| 369_F06 | DDYSMN (SEQ ID NO: 2729) | WVAGINYNGGYKG (SEQ ID NO: 2977) | ARSANWHDTALD (SEQ ID NO: 3225) | VSYVNWY (SEQ ID NO: 3473) | LVIYAATSRA (SEQ ID NO: 3721) | QQSYDSPL (SEQ ID NO: 3969) |
| 369_F10 | DSYGMN (SEQ ID NO: 2730) | WVSNINYNSGYKS (SEQ ID NO: 2978) | ARSANWHDTALD (SEQ ID NO: 3226) | VTYLNWY (SEQ ID NO: 3474) | LLIYAVTSRA (SEQ ID NO: 3722) | QQSYDLPL (SEQ ID NO: 3970) |
| 369_F11 | DSYGMN (SEQ ID NO: 2731) | WVSNINYNSGYKS (SEQ ID NO: 2979) | ARSANWHDTALD (SEQ ID NO: 3227) | ISYLNWY (SEQ ID NO: 3475) | LLIYAATSRA (SEQ ID NO: 3723) | QQSYDLPL (SEQ ID NO: 3971) |
| 369_G01 | SSYSMN (SEQ ID NO: 2732) | WVSNINYNSGYKS (SEQ ID NO: 2980) | ARSANWHDTALD (SEQ ID NO: 3228) | LSYVNWY (SEQ ID NO: 3476) | LLIYAATSRA (SEQ ID NO: 3724) | QQSYSSPL (SEQ ID NO: 3972) |
| 369_G04 | DSYSMN (SEQ ID NO: 2733) | WVSGINYNGGYTS (SEQ ID NO: 2981) | ARSANWHDTALD (SEQ ID NO: 3229) | LTYVNWY (SEQ ID NO: 3477) | LLIYATTSRH (SEQ ID NO: 3725) | QQSYETPL (SEQ ID NO: 3973) |
| 369_G06 | DSYGMN (SEQ ID NO: 2734) | WVAGINYNGGYTS (SEQ ID NO: 2982) | ARSANWHDTALD (SEQ ID NO: 3230) | LSYVNWY (SEQ ID NO: 3478) | LVIYAATSRA (SEQ ID NO: 3726) | QQSYENPL (SEQ ID NO: 3974) |
| 369_G11 | SSYSMN (SEQ ID NO: 2735) | WVANINYNSGYKG (SEQ ID NO: 2983) | ARSANWHDTALD (SEQ ID NO: 3231) | LTYLNWY (SEQ ID NO: 3479) | LLIYAATSLA (SEQ ID NO: 3727) | QQSYESPL (SEQ ID NO: 3975) |
| 369_G12 | SSYSMN (SEQ ID NO: 2736) | WVANINYNGGYTG (SEQ ID NO: 2984) | ARSANWHDTALD (SEQ ID NO: 3232) | LTYVNWY (SEQ ID NO: 3480) | LVIYAATSRH (SEQ ID NO: 3728) | QQSDNTPL (SEQ ID NO: 3976) |
| 369_H05 | SSYGMN (SEQ ID NO: 2737) | WVANINYNGGYTG (SEQ ID NO: 2985) | ARSANWHDTALD (SEQ ID NO: 3233) | VSYVNWY (SEQ ID NO: 3481) | LLIYAATSRA (SEQ ID NO: 3729) | QQSYSNPL (SEQ ID NO: 3977) |
| 369_H06 | SSYGMN (SEQ ID NO: 2738) | WVANINYNGGYKS (SEQ ID NO: 2986) | ARSANWHDTALD (SEQ ID NO: 3234) | VSYVNWY (SEQ ID NO: 3482) | LLIYAATSRA (SEQ ID NO: 3730) | QQSYDTPL (SEQ ID NO: 3978) |
| 369_H09 | DDYSMN (SEQ ID NO: 2739) | WVSGINYNGGYTS (SEQ ID NO: 2987) | ARSANWHDTALD (SEQ ID NO: 3235) | LSYVNWY (SEQ ID NO: 3483) | LLIYAVTSLA (SEQ ID NO: 3731) | QQSYESPL (SEQ ID NO: 3979) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 370_A01 | SSYSMN (SEQ ID NO: 2740) | WVSGINYNSGYKS (SEQ ID NO: 2988) | ARSANWHDTALD (SEQ ID NO: 3236) | STYLNWY (SEQ ID NO: 3484) | LVIYAATSRA (SEQ ID NO: 3732) | QQSYNLPL (SEQ ID NO: 3980) |
| 370_A03 | SSYSMN (SEQ ID NO: 2741) | WVSNINYNGGYTS (SEQ ID NO: 2989) | ARSANWHDTALD (SEQ ID NO: 3237) | LSYLNWY (SEQ ID NO: 3485) | LLIYAATSRA (SEQ ID NO: 3733) | QQSYDSPL (SEQ ID NO: 3981) |
| 370_A04 | DSYSMN (SEQ ID NO: 2742) | WVSGINYNGGYTS (SEQ ID NO: 2990) | ARSANWHDTALD (SEQ ID NO: 3238) | ITYLNWY (SEQ ID NO: 3486) | LLIYAATSRA (SEQ ID NO: 3734) | QQSYDNPL (SEQ ID NO: 3982) |
| 370_A12 | SSYGMN (SEQ ID NO: 2743) | WVAGINYNGGYTS (SEQ ID NO: 2991) | ARSANWHDTALD (SEQ ID NO: 3239) | LTYLNWY (SEQ ID NO: 3487) | LLIYAATSLA (SEQ ID NO: 3735) | QQSYDSPL (SEQ ID NO: 3983) |
| 370_C01 | DSYSMN (SEQ ID NO: 2744) | WVSGINYNSGYTG (SEQ ID NO: 2992) | ARSANWHDTALD (SEQ ID NO: 3240) | LTYLNWY (SEQ ID NO: 3488) | LVIYAATSLA (SEQ ID NO: 3736) | QQSYDTPL (SEQ ID NO: 3984) |
| 370_C03 | SSYGMN (SEQ ID NO: 2745) | WVAGINYNGGYKG (SEQ ID NO: 2993) | ARSANWHDTALD (SEQ ID NO: 3241) | LTYLNWY (SEQ ID NO: 3489) | LLIYYVTNRQ (SEQ ID NO: 3737) | QQSYSSPL (SEQ ID NO: 3985) |
| 370_C05 | SSYSMN (SEQ ID NO: 2746) | WVAGINYNSGYTG (SEQ ID NO: 2994) | ARSANWHDTALD (SEQ ID NO: 3242) | LSYVNWY (SEQ ID NO: 3490) | LVIYAATSRA (SEQ ID NO: 3738) | QQSYNSPL (SEQ ID NO: 3986) |
| 370_C08 | SSYGMN (SEQ ID NO: 2747) | WVAGINYNGGYKG (SEQ ID NO: 2995) | ARSANWHDTALD (SEQ ID NO: 3243) | SNYLNWY (SEQ ID NO: 3491) | LLIYAVTSRA (SEQ ID NO: 3739) | QQSYDSPL (SEQ ID NO: 3987) |
| 370_C09 | DSYGMN (SEQ ID NO: 2748) | WVSGINYNGGYTS (SEQ ID NO: 2996) | ARSANWHDTALD (SEQ ID NO: 3244) | ISYLNWY (SEQ ID NO: 3492) | LVIYAATSLA (SEQ ID NO: 3740) | QQSYSTPL (SEQ ID NO: 3988) |
| 370_D04 | DSYSMN (SEQ ID NO: 2749) | WVANINYNSGYKG (SEQ ID NO: 2997) | ARSANWHDTALD (SEQ ID NO: 3245) | LTYLNWY (SEQ ID NO: 3493) | LVIYAATSRA (SEQ ID NO: 3741) | QQSYDNPL (SEQ ID NO: 3989) |
| 370_D11 | DSYSMN (SEQ ID NO: 2750) | WVSGINYNGGYTG (SEQ ID NO: 2998) | ARSANWHDTALD (SEQ ID NO: 3246) | VSYLNWY (SEQ ID NO: 3494) | LLIYAATSRA (SEQ ID NO: 3742) | QQSYDTPL (SEQ ID NO: 3990) |
| 370_E03 | SSYGMN (SEQ ID NO: 2751) | WVSSINYNGGYKG (SEQ ID NO: 2999) | ARSANWHDTALD (SEQ ID NO: 3247) | LTYLNWY (SEQ ID NO: 3495) | LVIYYASNRA (SEQ ID NO: 3743) | QQSYDSPL (SEQ ID NO: 3991) |
| 370_E06 | SSYGMN (SEQ ID NO: 2752) | WVSGINYNSGYKS (SEQ ID NO: 3000) | ARSANWHDTALD (SEQ ID NO: 3248) | LSYLNWY (SEQ ID NO: 3496) | LVIYATTSLA (SEQ ID NO: 3744) | QQSYDTPL (SEQ ID NO: 3992) |
| 370_E09 | DDSSMH (SEQ ID NO: 2753) | WVSNINYNGGYTG (SEQ ID NO: 3001) | AKSANWHDTALD (SEQ ID NO: 3249) | LSYVNWY (SEQ ID NO: 3497) | LVIYAATSRA (SEQ ID NO: 3745) | QQSYELPL (SEQ ID NO: 3993) |
| 370_F05 | SSYGMN (SEQ ID NO: 2754) | WVSGINYNSGYTS (SEQ ID NO: 3002) | ARSANWHDTALD (SEQ ID NO: 3250) | VSYVNWY (SEQ ID NO: 3498) | LVIYAATSRA (SEQ ID NO: 3746) | QQSYETPL (SEQ ID NO: 3994) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 370_F07 | DSYSMN (SEQ ID NO: 2755) | WVSNINYNGGYKG (SEQ ID NO: 3003) | ARSANWHDTALD (SEQ ID NO: 3251) | LSYLNWY (SEQ ID NO: 3499) | LLIYAATSRA (SEQ ID NO: 3747) | QQSYNLPL (SEQ ID NO: 3995) |
| 370_F10 | SSYSMN (SEQ ID NO: 2756) | WVAGINYNGGYTS (SEQ ID NO: 3004) | ARSANWHDTALD (SEQ ID NO: 3252) | VSYLNWY (SEQ ID NO: 3500) | LVIYAATSRA (SEQ ID NO: 3748) | QQSYNSPL (SEQ ID NO: 3996) |
| 370_G02 | SDYSMN (SEQ ID NO: 2757) | WVANINYNGGYKG (SEQ ID NO: 3005) | ARSANWHDTALD (SEQ ID NO: 3253) | VSYLNWY (SEQ ID NO: 3501) | LLIYAATSRH (SEQ ID NO: 3749) | QQSYDSPL (SEQ ID NO: 3997) |
| 370_G03 | SSYSMN (SEQ ID NO: 2758) | WVANINYNGGYTG (SEQ ID NO: 3006) | ARSANWHDTALD (SEQ ID NO: 3254) | LTYVNWY (SEQ ID NO: 3502) | LVIYATTSRA (SEQ ID NO: 3750) | QQSYNNPL (SEQ ID NO: 3998) |
| 370_G06 | SDYGMH (SEQ ID NO: 2759) | WVSSINYNGGYTS (SEQ ID NO: 3007) | ARSANWHDTALD (SEQ ID NO: 3255) | LSYVNWY (SEQ ID NO: 3503) | LVIYAATSRA (SEQ ID NO: 3751) | QQSDNTPL (SEQ ID NO: 3999) |
| 370_G09 | SSYGMN (SEQ ID NO: 2760) | WVAGINYNGGYKS (SEQ ID NO: 3008) | ARSANWHDTALD (SEQ ID NO: 3256) | LSYVNWY (SEQ ID NO: 3504) | LVIYAATSRA (SEQ ID NO: 3752) | QQSYESPL (SEQ ID NO: 4000) |
| 370_G10 | SDYGMN (SEQ ID NO: 2761) | WVSGINYNSGYTS (SEQ ID NO: 3009) | ARSANWHDTALD (SEQ ID NO: 3257) | SSYLNWY (SEQ ID NO: 3505) | LLIYVVNNRA (SEQ ID NO: 3753) | QQSYENPL (SEQ ID NO: 4001) |
| 370_G11 | SSYSMN (SEQ ID NO: 2762) | WVASINYNSGYTS (SEQ ID NO: 3010) | ARSANWHDTHLD (SEQ ID NO: 3258) | VSYLNWY (SEQ ID NO: 3506) | LVIYAATSRA (SEQ ID NO: 3754) | QQSYSLPL (SEQ ID NO: 4002) |
| 370_H01 | SSYSMN (SEQ ID NO: 2763) | WVSGINYNSGYKG (SEQ ID NO: 3011) | ARSANWHDTALD (SEQ ID NO: 3259) | ISYLNWY (SEQ ID NO: 3507) | LLIYAVTSRA (SEQ ID NO: 3755) | QQSYDTPL (SEQ ID NO: 4003) |
| 370_H09 | SSYGMN (SEQ ID NO: 2764) | WVANINYNGGYTS (SEQ ID NO: 3012) | ARSANWHDTALD (SEQ ID NO: 3260) | VSYVNWY (SEQ ID NO: 3508) | LLIYAATSRA (SEQ ID NO: 3756) | QQSYDNPL (SEQ ID NO: 4004) |
| 371_A03 | SDYGMN (SEQ ID NO: 2765) | WVANINYNGGYTG (SEQ ID NO: 3013) | ARSANWHDTALD (SEQ ID NO: 3261) | LSYLNWY (SEQ ID NO: 3509) | LVIYATTSRA (SEQ ID NO: 3757) | QQSYESPL (SEQ ID NO: 4005) |
| 371_A06 | SSYGMN (SEQ ID NO: 2766) | WVAGINYNGGYTS (SEQ ID NO: 3014) | ARSANWHDTALD (SEQ ID NO: 3262) | LTYLNWY (SEQ ID NO: 3510) | LVIYAATSRH (SEQ ID NO: 3758) | QQSYDSPL (SEQ ID NO: 4006) |
| 371_A07 | SDYSMN (SEQ ID NO: 2767) | WVSNINYNGGYKS (SEQ ID NO: 3015) | ARSANWHDTALD (SEQ ID NO: 3263) | LSYLNWY (SEQ ID NO: 3511) | LVIYATTSRA (SEQ ID NO: 3759) | QQSYDLPL (SEQ ID NO: 4007) |
| 371_A08 | SSYGMH (SEQ ID NO: 2768) | WVSSINYNGGYTS (SEQ ID NO: 3016) | ARSANWHDTALD (SEQ ID NO: 3264) | LSYLNWY (SEQ ID NO: 3512) | LVIYAATSRA (SEQ ID NO: 3760) | QQSYELPL (SEQ ID NO: 4008) |
| 371_A12 | DSYSMN (SEQ ID NO: 2769) | WVAGINYNSGYTS (SEQ ID NO: 3017) | ARSANWHDTALD (SEQ ID NO: 3265) | LSYVNWY (SEQ ID NO: 3513) | LVIYAATSLA (SEQ ID NO: 3761) | QQSYDTPL (SEQ ID NO: 4009) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 371_B06 | DSYSMN (SEQ ID NO: 2770) | WVAGINYNGGYKS (SEQ ID NO: 3018) | ARSANWHDTALD (SEQ ID NO: 3266) | LTYVNWY (SEQ ID NO: 3514) | LVIYAATSRH (SEQ ID NO: 3762) | QQSYNLPL (SEQ ID NO: 4010) |
| 371_B07 | DSYSMN (SEQ ID NO: 2771) | WVAGINYNGGYTS (SEQ ID NO: 3019) | ARSANWHDTALD (SEQ ID NO: 3267) | LTYVNWY (SEQ ID NO: 3515) | LLIYAATSRA (SEQ ID NO: 3763) | QQSYELPL (SEQ ID NO: 4011) |
| 371_C03 | SSYSMN (SEQ ID NO: 2772) | WVSNINYNGGYKG (SEQ ID NO: 3020) | ARSANWHDTALD (SEQ ID NO: 3268) | LSYLNWY (SEQ ID NO: 3516) | LVIYATTSRA (SEQ ID NO: 3764) | QQSYSTPL (SEQ ID NO: 4012) |
| 371_D06 | DDYSMN (SEQ ID NO: 2773) | WVAGINYNGGYTS (SEQ ID NO: 3021) | ARSANWHDTALD (SEQ ID NO: 3269) | ISYVNWY (SEQ ID NO: 3517) | LLIYAATSRA (SEQ ID NO: 3765) | QQSYSTPL (SEQ ID NO: 4013) |
| 371_D09 | SSYSMN (SEQ ID NO: 2774) | WVSNINYNSGYTG (SEQ ID NO: 3022) | ARSANWHDTALD (SEQ ID NO: 3270) | LTYLNWY (SEQ ID NO: 3518) | LVIYAATSRA (SEQ ID NO: 3766) | QQSYNNPL (SEQ ID NO: 4014) |
| 371_F01 | SSYSMN (SEQ ID NO: 2775) | WVAGINYNGGYTG (SEQ ID NO: 3023) | ARSANWHDTALD (SEQ ID NO: 3271) | LTYVNWY (SEQ ID NO: 3519) | LVIYAATSLA (SEQ ID NO: 3767) | QQSYNNPL (SEQ ID NO: 4015) |
| 371_F04 | DSYSMN (SEQ ID NO: 2776) | WVAGINYNSGYKG (SEQ ID NO: 3024) | ARSANWHDTALD (SEQ ID NO: 3272) | LSYLNWY (SEQ ID NO: 3520) | LLIYAATSRH (SEQ ID NO: 3768) | QQSYNNPL (SEQ ID NO: 4016) |
| 371_F06 | DSYSMN (SEQ ID NO: 2777) | WVANINYNGGYTS (SEQ ID NO: 3025) | ARSANWHDTALD (SEQ ID NO: 3273) | VSYLNWY (SEQ ID NO: 3521) | LVIYAATSRH (SEQ ID NO: 3769) | QQSYNSPL (SEQ ID NO: 4017) |
| 371_F08 | DDYSMN (SEQ ID NO: 2778) | WVSGINYNGGYTG (SEQ ID NO: 3026) | ARSANWHDTALD (SEQ ID NO: 3274) | VSYVNWY (SEQ ID NO: 3522) | LVIYAATSRH (SEQ ID NO: 3770) | QQSYESPL (SEQ ID NO: 4018) |
| 371_G05 | DSYSMN (SEQ ID NO: 2779) | WVSGINYNSGYTG (SEQ ID NO: 3027) | ARSANWHDTALD (SEQ ID NO: 3275) | SSYLNWY (SEQ ID NO: 3523) | LLIYAVTSRA (SEQ ID NO: 3771) | QQSYSSPL (SEQ ID NO: 4019) |
| 371_G10 | SSYSMN (SEQ ID NO: 2780) | WVSGINYNGGYKS (SEQ ID NO: 3028) | ARSANWHDTALD (SEQ ID NO: 3276) | SSYVNWY (SEQ ID NO: 3524) | LLIYAATSRH (SEQ ID NO: 3772) | QQSDDSPL (SEQ ID NO: 4020) |
| 371_H09 | DSYSMN (SEQ ID NO: 2781) | WVSNINYNGGYTS (SEQ ID NO: 3029) | ARSANWHDTALD (SEQ ID NO: 3277) | LTYVNWY (SEQ ID NO: 3525) | LVIYAATSLA (SEQ ID NO: 3773) | QQSYDSPL (SEQ ID NO: 4021) |
| 372_A04 | DSYSMN (SEQ ID NO: 2782) | WVSGINYNSGYTS (SEQ ID NO: 3030) | ARSANWHDTALD (SEQ ID NO: 3278) | LTYLNWY (SEQ ID NO: 3526) | LVIYAATSRA (SEQ ID NO: 3774) | QQSYETPL (SEQ ID NO: 4022) |
| 372_B04 | DSYGMN (SEQ ID NO: 2783) | WVANINYNGGYTS (SEQ ID NO: 3031) | ARSANWHDTALD (SEQ ID NO: 3279) | LSYVNWY (SEQ ID NO: 3527) | LVIYAATSLA (SEQ ID NO: 3775) | QQSYDSPL (SEQ ID NO: 4023) |
| 372_C07 | SDYSMN (SEQ ID NO: 2784) | WVSNINYNSGYTS (SEQ ID NO: 3032) | ARSANWHDTHLD (SEQ ID NO: 3280) | LSYLNWY (SEQ ID NO: 3528) | LVIYAATSRH (SEQ ID NO: 3776) | QQSDNTPL (SEQ ID NO: 4024) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 372_D02 | SSYGMH (SEQ ID NO: 2785) | WVAGINYNGGYTG (SEQ ID NO: 3033) | ARSANWHDTALD (SEQ ID NO: 3281) | LTYLNWY (SEQ ID NO: 3529) | LVIYAATSRA (SEQ ID NO: 3777) | QQSYDNPL (SEQ ID NO: 4025) |
| 372_F03 | SSYGMN (SEQ ID NO: 2786) | WVAGINYNGGYTS (SEQ ID NO: 3034) | ARSANWHDTALD (SEQ ID NO: 3282) | LSYLNWY (SEQ ID NO: 3530) | LVIYAATSRA (SEQ ID NO: 3778) | QQSYDTPL (SEQ ID NO: 4026) |
| 372_F06 | SDYGMN (SEQ ID NO: 2787) | WVAGINYNGGYKS (SEQ ID NO: 3035) | ARSANWHDTALD (SEQ ID NO: 3283) | LSYVNWY (SEQ ID NO: 3531) | LLIYAATSLA (SEQ ID NO: 3779) | QQSYETPL (SEQ ID NO: 4027) |
| 372_F08 | SDYSMN (SEQ ID NO: 2788) | WVSNINYNSGYTG (SEQ ID NO: 3036) | ARSANWHDTALD (SEQ ID NO: 3284) | LTYVNWY (SEQ ID NO: 3532) | LVIYAATSRA (SEQ ID NO: 3780) | QQSYDTPL (SEQ ID NO: 4028) |
| 372_F09 | DSYSMN (SEQ ID NO: 2789) | WVANINYNSGYKG (SEQ ID NO: 3037) | ARSANWHDTALD (SEQ ID NO: 3285) | LTYLNWY (SEQ ID NO: 3533) | LVIYAATSLA (SEQ ID NO: 3781) | QQSYSSPL (SEQ ID NO: 4029) |
| 373_A02 | DSYGMN (SEQ ID NO: 2790) | WVSGINYNGGYKG (SEQ ID NO: 3038) | ARSANWHDTALD (SEQ ID NO: 3286) | LSYVNWY (SEQ ID NO: 3534) | LVIYATTSLA (SEQ ID NO: 3782) | QQSYNTPL (SEQ ID NO: 4030) |
| 373_A08 | DSYGMN (SEQ ID NO: 2791) | WVSNINYNGGYTG (SEQ ID NO: 3039) | ARSANWHDTALD (SEQ ID NO: 3287) | VSYVNWY (SEQ ID NO: 3535) | LLIYAATSLA (SEQ ID NO: 3783) | QQSYSLPL (SEQ ID NO: 4031) |
| 373_A10 | SSYGMN (SEQ ID NO: 2792) | WVSGINYNSGYTS (SEQ ID NO: 3040) | ARSANWHDTALD (SEQ ID NO: 3288) | LSYLNWY (SEQ ID NO: 3536) | LVIYAATSRA (SEQ ID NO: 3784) | QQSYDLPL (SEQ ID NO: 4032) |
| 373_B04 | SSYGMN (SEQ ID NO: 2793) | WVAGINYNSGYKG (SEQ ID NO: 3041) | ARSANWHDTALD (SEQ ID NO: 3289) | LTYLNWY (SEQ ID NO: 3537) | LLIYAATSRA (SEQ ID NO: 3785) | QQSYETPL (SEQ ID NO: 4033) |
| 373_B06 | SDYSMN (SEQ ID NO: 2794) | WVAGINYNGGYTG (SEQ ID NO: 3042) | ARSANWHDTALD (SEQ ID NO: 3290) | LTYVNWY (SEQ ID NO: 3538) | LVIYAATSRH (SEQ ID NO: 3786) | QQSYESPL (SEQ ID NO: 4034) |
| 373_B10 | DSYGMN (SEQ ID NO: 2795) | WVSNINYNGGYTS (SEQ ID NO: 3043) | ARSANWHDTALD (SEQ ID NO: 3291) | LSYLNWY (SEQ ID NO: 3539) | LLIYAATSRA (SEQ ID NO: 3787) | QQSYDLPL (SEQ ID NO: 4035) |
| 373_B12 | DSYGMN (SEQ ID NO: 2796) | WVSSINYNSGYTS (SEQ ID NO: 3044) | ARSANWHDTALD (SEQ ID NO: 3292) | VSYVNWY (SEQ ID NO: 3540) | LLIYAATSRA (SEQ ID NO: 3788) | QQSYDSPL (SEQ ID NO: 4036) |
| 373_C02 | DDYSMN (SEQ ID NO: 2797) | WVSGINYNSGYKG (SEQ ID NO: 3045) | ARSANWHDTALD (SEQ ID NO: 3293) | LSYVNWY (SEQ ID NO: 3541) | LLIYAATSRA (SEQ ID NO: 3789) | QQSYNTPL (SEQ ID NO: 4037) |
| 373_C04 | SSYSMN (SEQ ID NO: 2798) | WVANINYNSGYTG (SEQ ID NO: 3046) | ARSANWHDTALD (SEQ ID NO: 3294) | ISYVNWY (SEQ ID NO: 3542) | LVIYAVTSRA (SEQ ID NO: 3790) | QQSYNSPL (SEQ ID NO: 4038) |
| 373_C06 | SSYSMN (SEQ ID NO: 2799) | WVAGINYNGGYTG (SEQ ID NO: 3047) | ARSANWHDTALD (SEQ ID NO: 3295) | VSYVNWY (SEQ ID NO: 3543) | LVIYAATSRA (SEQ ID NO: 3791) | QQSYDTPL (SEQ ID NO: 4039) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 373_C08 | SSYSMN (SEQ ID NO: 2800) | WVANINYNGGYTS (SEQ ID NO: 3048) | ARSANWHDTALD (SEQ ID NO: 3296) | ISYLNWY (SEQ ID NO: 3544) | LLIYAASSLQ (SEQ ID NO: 3792) | QQSYNNPL (SEQ ID NO: 4040) |
| 373_C11 | SSYSMN (SEQ ID NO: 2801) | WVSGINYNSGYTG (SEQ ID NO: 3049) | ARSANWHDTALD (SEQ ID NO: 3297) | LTYVNWY (SEQ ID NO: 3545) | LVIYAVTSRA (SEQ ID NO: 3793) | QQSYETPL (SEQ ID NO: 4041) |
| 373_D01 | DSYSMN (SEQ ID NO: 2802) | WVSGINYNSGYKS (SEQ ID NO: 3050) | ARSANWHDTHLD (SEQ ID NO: 3298) | LSYVNWY (SEQ ID NO: 3546) | LVIYAATSRA (SEQ ID NO: 3794) | QQSYDSPL (SEQ ID NO: 4042) |
| 373_D04 | DSYSMN (SEQ ID NO: 2803) | WVSGINYNSGYKG (SEQ ID NO: 3051) | ARSANWHDTALD (SEQ ID NO: 3299) | LSYLNWY (SEQ ID NO: 3547) | LLIYAATSRH (SEQ ID NO: 3795) | QQSYDSPL (SEQ ID NO: 4043) |
| 373_D05 | SSYSMN (SEQ ID NO: 2804) | WVSGINYNSGYKG (SEQ ID NO: 3052) | ARSANWHDTALD (SEQ ID NO: 3300) | LSYLNWY (SEQ ID NO: 3548) | LVIYAATSRA (SEQ ID NO: 3796) | QQSYDSPL (SEQ ID NO: 4044) |
| 373_D08 | SSYSMN (SEQ ID NO: 2805) | WVSGINYNGGYKS (SEQ ID NO: 3053) | ARSANWHDTALD (SEQ ID NO: 3301) | LSYVNWY (SEQ ID NO: 3549) | LLIYAATSRA (SEQ ID NO: 3797) | QQSYDSPL (SEQ ID NO: 4045) |
| 373_D10 | DSYSMN (SEQ ID NO: 2806) | WVSNINYNSGYKG (SEQ ID NO: 3054) | ARSANWHDTALD (SEQ ID NO: 3302) | LSYVNWY (SEQ ID NO: 3550) | LLIYAATSRA (SEQ ID NO: 3798) | QQSYDLPL (SEQ ID NO: 4046) |
| 373_E01 | SSYGMN (SEQ ID NO: 2807) | WVSGINYNGGYKG (SEQ ID NO: 3055) | ARSANWHDTALD (SEQ ID NO: 3303) | VSYVNWY (SEQ ID NO: 3551) | LLIYAATSRH (SEQ ID NO: 3799) | QQSYNNPL (SEQ ID NO: 4047) |
| 373_E05 | DSYGMN (SEQ ID NO: 2808) | WVSNINYNGGYTS (SEQ ID NO: 3056) | ARSANWHDTALD (SEQ ID NO: 3304) | LSYVNWY (SEQ ID NO: 3552) | LLIYAVTSRA (SEQ ID NO: 3800) | QQSYDLPL (SEQ ID NO: 4048) |
| 373_E07 | SSYGMN (SEQ ID NO: 2809) | WVANINYNGGYTS (SEQ ID NO: 3057) | ARSANWHDTALD (SEQ ID NO: 3305) | LTYVNWY (SEQ ID NO: 3553) | LLIYAATSLA (SEQ ID NO: 3801) | QQSYETPL (SEQ ID NO: 4049) |
| 373_E12 | SSYSMN (SEQ ID NO: 2810) | WVANINYNGGYTG (SEQ ID NO: 3058) | ARSANWHDTALD (SEQ ID NO: 3306) | LSYVNWY (SEQ ID NO: 3554) | LVIYAATSRA (SEQ ID NO: 3802) | QQSYDTPL (SEQ ID NO: 4050) |
| 373_G10 | SDYGMN (SEQ ID NO: 2811) | WVSNINYNGGYKS (SEQ ID NO: 3059) | ARSANWHDTALD (SEQ ID NO: 3307) | VSYVNWY (SEQ ID NO: 3555) | LLIYAATSRA (SEQ ID NO: 3803) | QQSYDLPL (SEQ ID NO: 4051) |
| 373_G12 | SSYSMN (SEQ ID NO: 2812) | WVSNINYNGGYTS (SEQ ID NO: 3060) | ARSANWHDTALD (SEQ ID NO: 3308) | LSYLNWY (SEQ ID NO: 3556) | LLIYATTSLA (SEQ ID NO: 3804) | QQSYNSPL (SEQ ID NO: 4052) |
| 373_H01 | DSYSMN (SEQ ID NO: 2813) | WVANINYNGGYTG (SEQ ID NO: 3061) | ARSANWHDTALD (SEQ ID NO: 3309) | LSYLNWY (SEQ ID NO: 3557) | LVIYAATSRA (SEQ ID NO: 3805) | QQSYDNPL (SEQ ID NO: 4053) |
| 373_H05 | SDYSMN (SEQ ID NO: 2814) | WVANINYNGGYKG (SEQ ID NO: 3062) | ARSANWHDTALD (SEQ ID NO: 3310) | LTYVNWY (SEQ ID NO: 3558) | LVIYAATSRA (SEQ ID NO: 3806) | QQSYETPL (SEQ ID NO: 4054) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 374_A07 | SSYSMN (SEQ ID NO: 2815) | WVSGINYNSGYKG (SEQ ID NO: 3063) | ARSANWHDTALD (SEQ ID NO: 3311) | LSYVNWY (SEQ ID NO: 3559) | LLIYAVTSRA (SEQ ID NO: 3807) | QQSYDLPL (SEQ ID NO: 4055) |
| 374_B04 | SSYSMN (SEQ ID NO: 2816) | WVSNINYNSGYTG (SEQ ID NO: 3064) | ARSANWHDTALD (SEQ ID NO: 3312) | VSYLNWY (SEQ ID NO: 3560) | LLIYAVTSRA (SEQ ID NO: 3808) | QQSYESPL (SEQ ID NO: 4056) |
| 374_B06 | DSYSMN (SEQ ID NO: 2817) | WVAGINYNSGYKG (SEQ ID NO: 3065) | ARSANWHDTHLD (SEQ ID NO: 3313) | LTYVNWY (SEQ ID NO: 3561) | LLIYAATSRA (SEQ ID NO: 3809) | QQSYDTPL (SEQ ID NO: 4057) |
| 374_B12 | DSYSMN (SEQ ID NO: 2818) | WVAGINYNGGYTG (SEQ ID NO: 3066) | ARSANWHDTHLD (SEQ ID NO: 3314) | SSYLNWY (SEQ ID NO: 3562) | LVIYAATSRA (SEQ ID NO: 3810) | QQSYDNPL (SEQ ID NO: 4058) |
| 374_C03 | DSYSMN (SEQ ID NO: 2819) | WVSGINYNSGYTS (SEQ ID NO: 3067) | ARSANWHDTALD (SEQ ID NO: 3315) | LTYLNWY (SEQ ID NO: 3563) | LLIYAATSRA (SEQ ID NO: 3811) | QQSYDSPL (SEQ ID NO: 4059) |
| 374_C06 | DDYSMN (SEQ ID NO: 2820) | WVSSINYNSGYKG (SEQ ID NO: 3068) | ARSANWHDTALD (SEQ ID NO: 3316) | LTYVNWY (SEQ ID NO: 3564) | LLIYAATSRA (SEQ ID NO: 3812) | QQSYNSPL (SEQ ID NO: 4060) |
| 374_D01 | DSYSMN (SEQ ID NO: 2821) | WVSGINYNSGYKG (SEQ ID NO: 3069) | ARSANWHDTALD (SEQ ID NO: 3317) | ITYVNWY (SEQ ID NO: 3565) | LLIYAATSLA (SEQ ID NO: 3813) | QQSYSSPL (SEQ ID NO: 4061) |
| 374_D08 | DSYGMN (SEQ ID NO: 2822) | WVSGINYNSGYTG (SEQ ID NO: 3070) | ARSANWHDTHLD (SEQ ID NO: 3318) | LTYLNWY (SEQ ID NO: 3566) | LLIYAATSRH (SEQ ID NO: 3814) | QQSYESPL (SEQ ID NO: 4062) |
| 374_E01 | SSYGMN (SEQ ID NO: 2823) | WVAGINYNGGYTS (SEQ ID NO: 3071) | ARSANWHDTALD (SEQ ID NO: 3319) | SSYVNWY (SEQ ID NO: 3567) | LLIYAATSRA (SEQ ID NO: 3815) | QQSYSTPL (SEQ ID NO: 4063) |
| 374_E02 | SSYSMN (SEQ ID NO: 2824) | WVSGINYNGGYTS (SEQ ID NO: 3072) | ARSANWHDTALD (SEQ ID NO: 3320) | LSYLNWY (SEQ ID NO: 3568) | LLIYAATSLA (SEQ ID NO: 3816) | QQSYDLPL (SEQ ID NO: 4064) |
| 374_E05 | SSYSMN (SEQ ID NO: 2825) | WVAGINYNGGYTS (SEQ ID NO: 3073) | ARSANWHDTALD (SEQ ID NO: 3321) | LSFVNWY (SEQ ID NO: 3569) | LVIYAATSRA (SEQ ID NO: 3817) | QQSYNLPL (SEQ ID NO: 4065) |
| 374_E07 | SDYSMN (SEQ ID NO: 2826) | WVAGINYNGGYTS (SEQ ID NO: 3074) | ARSANWHDTALD (SEQ ID NO: 3322) | ITYVNWY (SEQ ID NO: 3570) | LVIYAATSRA (SEQ ID NO: 3818) | QQSYNTPL (SEQ ID NO: 4066) |
| 374_E08 | SSYGMN (SEQ ID NO: 2827) | WVAGINYNGGYKS (SEQ ID NO: 3075) | ARSANWHDTALD (SEQ ID NO: 3323) | LSYLNWY (SEQ ID NO: 3571) | LLIYAATSRH (SEQ ID NO: 3819) | QQSYDLPL (SEQ ID NO: 4067) |
| 374_E11 | SSYGMN (SEQ ID NO: 2828) | WVSNINYNGGYTS (SEQ ID NO: 3076) | ARSANWHDTALD (SEQ ID NO: 3324) | VTYLNWY (SEQ ID NO: 3572) | LVIYAATSRA (SEQ ID NO: 3820) | QQSYDSPL (SEQ ID NO: 4068) |
| 374_F01 | DSYSMN (SEQ ID NO: 2829) | WVSNINYNGGYTG (SEQ ID NO: 3077) | ARSANWHDTALD (SEQ ID NO: 3325) | LSYVNWY (SEQ ID NO: 3573) | LVIYAATSRH (SEQ ID NO: 3821) | QQSYENPL (SEQ ID NO: 4069) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 374_F02 | DSYSMN (SEQ ID NO: 2830) | WVANINYNSGYTS (SEQ ID NO: 3078) | ARSANWHDTALD (SEQ ID NO: 3326) | VSYLNWY (SEQ ID NO: 3574) | LLIYAASSLQ (SEQ ID NO: 3822) | QQSYELPL (SEQ ID NO: 4070) |
| 374_F04 | SSYGMN (SEQ ID NO: 2831) | WVSGINYNSGYKS (SEQ ID NO: 3079) | ARSANWHDTALD (SEQ ID NO: 3327) | LTYVNWY (SEQ ID NO: 3575) | LLIYAATSRA (SEQ ID NO: 3823) | QQSYNSPL (SEQ ID NO: 4071) |
| 374_F10 | SSYSMN (SEQ ID NO: 2832) | WVSGINYNGGYTS (SEQ ID NO: 3080) | ARSANWHDTALD (SEQ ID NO: 3328) | LSYLNWY (SEQ ID NO: 3576) | LVIYAATSRA (SEQ ID NO: 3824) | QQSYDNPL (SEQ ID NO: 4072) |
| 374_F11 | DSYSMN (SEQ ID NO: 2833) | WVSNINYNGGYTG (SEQ ID NO: 3081) | ARSANWHDTALD (SEQ ID NO: 3329) | LSYLNWY (SEQ ID NO: 3577) | LLIYAVTSLA (SEQ ID NO: 3825) | QQSYESPL (SEQ ID NO: 4073) |
| 374_G04 | SSYSMN (SEQ ID NO: 2834) | WVAGINYNGGYTG (SEQ ID NO: 3082) | ARSANWHDTALD (SEQ ID NO: 3330) | LTYLNWY (SEQ ID NO: 3578) | LVIYAATSLA (SEQ ID NO: 3826) | QQSYDNPL (SEQ ID NO: 4074) |
| 374_G06 | SSYGMH (SEQ ID NO: 2835) | WVASINYNGGYTS (SEQ ID NO: 3083) | ARSANWHDTALD (SEQ ID NO: 3331) | LSYLNWY (SEQ ID NO: 3579) | LLIYAVTSRA (SEQ ID NO: 3827) | QQSYDLPL (SEQ ID NO: 4075) |
| 374_G07 | SSYSMN (SEQ ID NO: 2836) | WVSGINYNSGYKS (SEQ ID NO: 3084) | ARSANWHDTALD (SEQ ID NO: 3332) | ISYLNWY (SEQ ID NO: 3580) | LLIYAATSRA (SEQ ID NO: 3828) | QQSYDSPL (SEQ ID NO: 4076) |
| 374_H03 | SSYGMN (SEQ ID NO: 2837) | WVSGINYNSGYKS (SEQ ID NO: 3085) | ARSANWHDTALD (SEQ ID NO: 3333) | LSYVNWY (SEQ ID NO: 3581) | LVIYAATSRA (SEQ ID NO: 3829) | QQSYDSPL (SEQ ID NO: 4077) |
| 374_H04 | DSYSMN (SEQ ID NO: 2838) | WVSGINYNSGYTS (SEQ ID NO: 3086) | ARSANWHDTALD (SEQ ID NO: 3334) | LTYLNWY (SEQ ID NO: 3582) | LLIYAATSRA (SEQ ID NO: 3830) | QQSYDNPL (SEQ ID NO: 4078) |
| 374_H06 | SSYGMN (SEQ ID NO: 2839) | WVSNINYNGGYTG (SEQ ID NO: 3087) | ARSANWHDTALD (SEQ ID NO: 3335) | VSYVNWY (SEQ ID NO: 3583) | LVIYAATSRA (SEQ ID NO: 3831) | QQSYNLPL (SEQ ID NO: 4079) |
| 374_H07 | DSYGMN (SEQ ID NO: 2840) | WVANINYNGGYTG (SEQ ID NO: 3088) | ARSANWHDTALD (SEQ ID NO: 3336) | LTYLNWY (SEQ ID NO: 3584) | LLIYAATSRA (SEQ ID NO: 3832) | QQSYETPL (SEQ ID NO: 4080) |
| 374_H09 | SSYSMN (SEQ ID NO: 2841) | WVANINYNSGYKS (SEQ ID NO: 3089) | ARSANWHDTALD (SEQ ID NO: 3337) | LSYLNWY (SEQ ID NO: 3585) | LVIYAVTSLA (SEQ ID NO: 3833) | QQSYDLPL (SEQ ID NO: 4081) |
| 375_A05 | SSYGMN (SEQ ID NO: 2842) | WVANINYNGGYKG (SEQ ID NO: 3090) | ARSANWHDTALD (SEQ ID NO: 3338) | LSYLNWY (SEQ ID NO: 3586) | LLIYAATSRA (SEQ ID NO: 3834) | QQSYDLPL (SEQ ID NO: 4082) |
| 375_C06 | DDYGMH (SEQ ID NO: 2843) | WVASINYNSGYTS (SEQ ID NO: 3091) | ARSANWHDTALD (SEQ ID NO: 3339) | LTYVNWY (SEQ ID NO: 3587) | LVIYATTSRA (SEQ ID NO: 3835) | QQSYDSPL (SEQ ID NO: 4083) |
| 375_D04 | DDSSMH (SEQ ID NO: 2844) | WVSNINYNGGYTG (SEQ ID NO: 3092) | AKSANWHDTALD (SEQ ID NO: 3340) | LSYVNWY (SEQ ID NO: 3588) | LVIYAATSRA (SEQ ID NO: 3836) | QQSYELPL (SEQ ID NO: 4084) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 375_D05 | SSYSMN (SEQ ID NO: 2845) | WVASINYNSGYTS (SEQ ID NO: 3093) | ARSANWHDTHLD (SEQ ID NO: 3341) | VSYLNWY (SEQ ID NO: 3589) | LLIYAATSLH (SEQ ID NO: 3837) | QQSYDTPL (SEQ ID NO: 4085) |
| 375_D07 | SSYGMN (SEQ ID NO: 2846) | WVANINYNSGYTG (SEQ ID NO: 3094) | ARSANWHDTALD (SEQ ID NO: 3342) | ITYLNWY (SEQ ID NO: 3590) | LLIYAATSRA (SEQ ID NO: 3838) | QQSYDTPL (SEQ ID NO: 4086) |
| 375_D08 | SDYGMN (SEQ ID NO: 2847) | WVSGINYNSGYKG (SEQ ID NO: 3095) | ARSANWHDTALD (SEQ ID NO: 3343) | ITYLNWY (SEQ ID NO: 3591) | LLIYAATSRA (SEQ ID NO: 3839) | QQSYSTPL (SEQ ID NO: 4087) |
| 375_D12 | DSYGMN (SEQ ID NO: 2848) | WVSSINYNSGYTS (SEQ ID NO: 3096) | ARSANWHDTALD (SEQ ID NO: 3344) | LTYVNWY (SEQ ID NO: 3592) | LVIYAATSRA (SEQ ID NO: 3840) | QQSYETPL (SEQ ID NO: 4088) |
| 375_E01 | SSYSMN (SEQ ID NO: 2849) | WVSGINYNSGYKS (SEQ ID NO: 3097) | ARSANWHDTALD (SEQ ID NO: 3345) | LTYLNWY (SEQ ID NO: 3593) | LVIYAATSRA (SEQ ID NO: 3841) | QQSDDSPL (SEQ ID NO: 4089) |
| 375_E07 | SDYSMN (SEQ ID NO: 2850) | WVAGINYNSGYKG (SEQ ID NO: 3098) | ARSANWHDTALD (SEQ ID NO: 3346) | VTYLNWY (SEQ ID NO: 3594) | LLIYVVTNRE (SEQ ID NO: 3842) | QQSYETPL (SEQ ID NO: 4090) |
| 375_H12 | SSYGMN (SEQ ID NO: 2851) | WVAGINYNGGYKG (SEQ ID NO: 3099) | ARSANWHDTALD (SEQ ID NO: 3347) | LTYLNWY (SEQ ID NO: 3595) | LLIYYVTNRQ (SEQ ID NO: 3843) | QQSYSIPL (SEQ ID NO: 4091) |
| 376_A04 | DSYSMN (SEQ ID NO: 2852) | WVSNINYNGGYTS (SEQ ID NO: 3100) | ARSANWHDTALD (SEQ ID NO: 3348) | VTYLNWY (SEQ ID NO: 3596) | LVIYAATSRA (SEQ ID NO: 3844) | QQSYDSPL (SEQ ID NO: 4092) |
| 376_A10 | SDYGMN (SEQ ID NO: 2853) | WVSNINYNSGYKG (SEQ ID NO: 3101) | ARSANWHDTALD (SEQ ID NO: 3349) | LSYLNWY (SEQ ID NO: 3597) | LLIYAATSRA (SEQ ID NO: 3845) | QQSYESPL (SEQ ID NO: 4093) |
| 376_A12 | SSYSMN (SEQ ID NO: 2854) | WVANINYNSGYKG (SEQ ID NO: 3102) | ARSANWHDTALD (SEQ ID NO: 3350) | LSYVNWY (SEQ ID NO: 3598) | LVIYAATSRA (SEQ ID NO: 3846) | QQSYDTPL (SEQ ID NO: 4094) |
| 376_B04 | DSYGMH (SEQ ID NO: 2855) | WVASINYNGGYTG (SEQ ID NO: 3103) | ARSANWHDTALD (SEQ ID NO: 3351) | VSYVNWY (SEQ ID NO: 3599) | LVIYAATSRA (SEQ ID NO: 3847) | QQSYDTPL (SEQ ID NO: 4095) |
| 376_B05 | SSYSMN (SEQ ID NO: 2856) | WVANINYNGGYTG (SEQ ID NO: 3104) | ARSANWHDTALD (SEQ ID NO: 3352) | ISYVNWY (SEQ ID NO: 3600) | LLIYAATSRA (SEQ ID NO: 3848) | QQSYELPL (SEQ ID NO: 4096) |
| 376_B09 | DSYSMN (SEQ ID NO: 2857) | WVANINYNSGYKG (SEQ ID NO: 3105) | ARSANWHDTALD (SEQ ID NO: 3353) | LTYVNWY (SEQ ID NO: 3601) | LVIYAATSRA (SEQ ID NO: 3849) | QQSYDLPL (SEQ ID NO: 4097) |
| 376_B11 | SSYSMN (SEQ ID NO: 2858) | WVSGINYNGGYTS (SEQ ID NO: 3106) | ARSANWHDTALD (SEQ ID NO: 3354) | LSYVNWY (SEQ ID NO: 3602) | LVIYAATSRA (SEQ ID NO: 3850) | QQSYDLPL (SEQ ID NO: 4098) |
| 376_C01 | DSYSMN (SEQ ID NO: 2859) | WVAGINYNGGYTS (SEQ ID NO: 3107) | ARSANWHDTALD (SEQ ID NO: 3355) | LTYLNWY (SEQ ID NO: 3603) | LLIYAATSLA (SEQ ID NO: 3851) | QQSYDNPL (SEQ ID NO: 4099) |

TABLE 3E-continued

CDR sequences for Group V antibodies

| Ab | HCDR1 | HCDR2 | HCDR3 | LCDR1 | LCDR2 | LCDR3 |
|---|---|---|---|---|---|---|
| 376_C02 | DSYGMN (SEQ ID NO: 2860) | WVSGINYNSGYTS (SEQ ID NO: 3108) | ARSANWHDTALD (SEQ ID NO: 3356) | VSYLNWY (SEQ ID NO: 3604) | LVIYAVTSRA (SEQ ID NO: 3852) | QQSYDSPL (SEQ ID NO: 4100) |
| 376_C12 | SSYSMN (SEQ ID NO: 2861) | WVAGINYNGGYTG (SEQ ID NO: 3109) | ARSANWHDTALD (SEQ ID NO: 3357) | LTYVNWY (SEQ ID NO: 3605) | LLIYAATSRA (SEQ ID NO: 3853) | QQSYDSPL (SEQ ID NO: 4101) |
| 376_D05 | SSYSMN (SEQ ID NO: 2862) | WVSNINYNGGYKG (SEQ ID NO: 3110) | ARSANWHDTALD (SEQ ID NO: 3358) | VSYVNWY (SEQ ID NO: 3606) | LLIYAATSLA (SEQ ID NO: 3854) | QQSYDTPL (SEQ ID NO: 4102) |
| 376_D11 | SSYGMN (SEQ ID NO: 2863) | WVANINYNGGYTG (SEQ ID NO: 3111) | ARSANWHDTALD (SEQ ID NO: 3359) | LSYLNWY (SEQ ID NO: 3607) | LVIYAATSRA (SEQ ID NO: 3855) | QQSYNNPL (SEQ ID NO: 4103) |
| 376_E03 | SSYGMN (SEQ ID NO: 2864) | WVANINYNGGYTG (SEQ ID NO: 3112) | ARSANWHDTALD (SEQ ID NO: 3360) | LSYVNWY (SEQ ID NO: 3608) | LVIYAATSLA (SEQ ID NO: 3856) | QQSYDLPL (SEQ ID NO: 4104) |
| 376_E08 | SDYGMN (SEQ ID NO: 2865) | WVAGINYNGGYTS (SEQ ID NO: 3113) | ARSANWHDTALD (SEQ ID NO: 3361) | VSYVNWY (SEQ ID NO: 3609) | LVIYAATSRA (SEQ ID NO: 3857) | QQSYDSPL (SEQ ID NO: 4105) |
| 376_F03 | DSYGMN (SEQ ID NO: 2866) | WVANINYNGGYTG (SEQ ID NO: 3114) | ARSANWHDTALD (SEQ ID NO: 3362) | ITYVNWY (SEQ ID NO: 3610) | LVIYATTSLA (SEQ ID NO: 3858) | QQSYSSPL (SEQ ID NO: 4106) |
| 376_F04 | DSYSMN (SEQ ID NO: 2867) | WVSNINYNSGYTG (SEQ ID NO: 3115) | ARSANWHDTALD (SEQ ID NO: 3363) | SSYLNWY (SEQ ID NO: 3611) | LLIYAASSLQ (SEQ ID NO: 3859) | QQSYSTPL (SEQ ID NO: 4107) |
| 376_G08 | DSYGMN (SEQ ID NO: 2868) | WVANINYNGGYTS (SEQ ID NO: 3116) | ARSANWHDTALD (SEQ ID NO: 3364) | LSYVNWY (SEQ ID NO: 3612) | LVIYAATSRA (SEQ ID NO: 3860) | QQSYDTPL (SEQ ID NO: 4108) |
| 376_G09 | DSYSMN (SEQ ID NO: 2869) | WVSGINYNSGYKG (SEQ ID NO: 3117) | ARSANWHDTALD (SEQ ID NO: 3365) | SYYLNWY (SEQ ID NO: 3613) | LLIYAVTSRA (SEQ ID NO: 3861) | QQSYDNPL (SEQ ID NO: 4109) |
| 376_H09 | SDYSMN (SEQ ID NO: 2870) | WVANINYNGGYTG (SEQ ID NO: 3118) | ARSANWHDTALD (SEQ ID NO: 3366) | ITYLNWY (SEQ ID NO: 3614) | LVIYYVSNLP (SEQ ID NO: 3862) | QQSYDSPL (SEQ ID NO: 4110) |
| 376_H10 | DSYSMN (SEQ ID NO: 2871) | WVSGINYNSGYKS (SEQ ID NO: 3119) | ARSANWHDTALD (SEQ ID NO: 3367) | LTYLNWY (SEQ ID NO: 3615) | LVIYAATSRH (SEQ ID NO: 3863) | QQSYDSPL (SEQ ID NO: 4111) |

The consensus sequences for each of these CDRs shown in FIG. 3E are as follows:

```
                                         (SEQ ID NO: 6578)
    HCDR1: S/DS/DYG/SMN/H (SEQ ID NO: 6579)
    HCDR2: WVS/AG/N/SINYNG/SGYT/KS/G (SEQ ID NO: 6597)
    HCDR3: AR/KSANWHDTA/HLD (SEQ ID NO: 6561)
    LCDR1: L/V/I/SS/TYLNNWY (SEQ ID NO: 6582)
    LCDR2: LL/VIYA/YA/V/TT/SS/NR/LA/H/Q (SEQ ID NO: 6598)
    LCDR3: QQSY/DD/E/N/SS/T/L/NPL
```

TABLE 2F

| | Group IV Antibody Sequences | |
|---|---|---|
| Ab | VH sequence | VL sequence |
| 365_E02 | EVQLLESGGGLVQPGGSLRLSCAASGFT FSSYSMNWVRQAPGKGLEWVANINYNGG YTSYADSVKGRFTISRDNSKNTLYLQMN SLRAEDTAVYYCAKSATWHDTHLDYWGQ GTLVTVSS (SEQ ID NO: 4112) | DIQMTQSPSSLSASVGDRVTITCRASQSIISYLN WYQQKPGKAPKLLIYAATSRASGVPSRFSGSGSG TDFTLTISSLQPEDFATYYCQQSYENPLTFGGGT KVEIK (SEQ ID NO: 4281) |
| 370_G12 | EVQLLESGGGLVQPGGSLRLSCAASGFT FSSYSMNWVRQAPGKGLEWVAGINYNGG YKGYADSVKGRFTISRDNSKNTLYLQMN SLRAEDTAVYYCARSATWHDTALDYWGQ GTLVTVSS (SEQ ID NO: 4113) | DIQMTQSPSSLSASVGDRVTITCRASQSIITYLN WYQQKPGKAPKLLIYAATSLASGVPSRFSGSGSG TDFTLTISSLQPEDFATYYCQQSDESPLTFGGGT KVEIK (SEQ ID NO: 4282) |
| 368_C01 | EVQLLESGGGLVQPGGSLRLSCAASGFT FDSYGMNWVRQAPGKGLEWVAGINYNGG YTGYADSVKGRFTISRDNSKNTLYLQMN SLRAEDTAVYYCARSATWHDTALDYWGQ GTLVTVSS (SEQ ID NO: 4114) | DIQMTQSPSSLSASVGDRVTITCRASQSIITYLN WYQQKPGKAPKLLIYAATSRASGVPSRFSGSGSG TDFTLTISSLQPEDFATYYCQQSYDSPLTFGGGT KVEIK (SEQ ID NO: 4283) |
| 376_C06 | EVQLLESGGGLVQPGGSLRLSCAASGFT FSSYGMNWVRQAPGKGLEWVAGINYNGG YTSYADSVKGRFTISRDNSKNTLYLQMN SLRAEDTAVYYCARSATWHDTALDYWGQ GTLVTVSS (SEQ ID NO: 4115) | DIQMTQSPSSLSASVGDRVTITCRASQSILSYLN WYQQKPGKAPKLVIYAATSRASGVPSRFSGSGSG TDFTLTISSLQPEDFATYYCQQSYDSPLTFGGGT KVEIK (SEQ ID NO: 4284) |
| 368_D10 | EVQLLESGGGLVQPGGSLRLSCAASGFT FDSYGMNWVRQAPGKGLEWVAGINYNSG YTSYADSVKGRFTISRDNSKNTLYLQMN SLRAEDTAVYYCARSATWHDTALDYWGQ GTLVTVSS (SEQ ID NO: 4116) | DIQMTQSPSSLSASVGDRVTITCRASQSILSYLN WYQQKPGKAPKLVIYAATSRASGVPSRFSGSGSG TDFTLTISSLQPEDFATYYCQQSYDSPLTFGGGT KVEIK (SEQ ID NO: 4285) |
| 365_G12 | EVQLLESGGGLVQPGGSLRLSCAASGFT FSSYGMNWVRQAPGKGLEWVAGINYNSG YTSYADSVKGRFTISRDNSKNTLYLQMN SLRAEDTAVYYCARSATWHDTALDYWGQ GTLVTVSS (SEQ ID NO: 4117) | DIQMTQSPSSLSASVGDRVTITCRASQSILSYVN WYQQKPGKAPKLVIYAATSRASGVPSRFSGSGSG TDFTLTISSLQPEDFATYYCQQSYSNPLTFGGGT KVEIK (SEQ ID NO: 4286) |
| 367_C03 | EVQLLESGGGLVQPGGSLRLSCAASGFT FSSYSMNWVRQAPGKGLEWVANINYNGG YTGYADSVKGRFTISRDNSKNTLYLQMN SLRAEDTAVYYCARSATWHDTALDYWGQ GTLVTVSS (SEQ ID NO: 4118) | DIQMTQSPSSLSASVGDRVTITCRASQSILSYVN WYQQKPGKAPKLVIYATTSRASGVPSRFSGSGSG TDFTLTISSLQPEDFATYYCQQSYENPLTFGGGT KVEIK (SEQ ID NO: 4287) |
| 367_H07 | EVQLLESGGGLVQPGGSLRLSCAASGFT FSSYSMNWVRQAPGKGLEWVANINYNGG YTSYADSVKGRFTISRDNSKNTLYLQMN SLRAEDTAVYYCARSATWHDTALDYWGQ GTLVTVSS (SEQ ID NO: 4119) | DIQMTQSPSSLSASVGDRVTITCRASQSILSYVN WYQQKPGKAPKLVIYATTSRASGVPSRFSGSGSG TDFTLTISSLQPEDFATYYCQQSYENPLTFGGGT KVEIK (SEQ ID NO: 4288) |
| 371_D03 | EVQLLESGGGLVQPGGSLRLSCAASGFT FDSYGMNWVRQAPGKGLEWVANINYNGG YTSYADSVKGRFTISRDNSKNTLYLQMN SLRAEDTAVYYCARSATWHDTALDYWGQ GTLVTVSS (SEQ ID NO: 4120) | DIQMTQSPSSLSASVGDRVTITCRASQSILTYVN WYQQKPGKAPKLVIYAATSLASGVPSRFSGSGSG TDFTLTISSLQPEDFATYYCQQSYNTPLTFGGGT KVEIK (SEQ ID NO: 4289) |
| 369_C10 | EVQLLESGGGLVQPGGSLRLSCAASGFT FSSYSMNWVRQAPGKGLEWVANINYNGG YTSYADSVKGRFTISRDNSKNTLYLQMN SLRAEDTAVYYCARSATWHDTALDYWGQ GTLVTVSS (SEQ ID NO: 4121) | DIQMTQSPSSLSASVGDRVTITCRASQSIVTYLN WYQQKPGKAPKLVIYAATSLHSGVPSRFSGSGSG TDFTLTISSLQPEDFATYYCQQSDSLPLTFGGGT KVEIK (SEQ ID NO: 4290) |
| 367_F05 | EVQLLESGGGLVQPGGSLRLSCAASGFT FSSYGMNWVRQAPGKGLEWVASINYNGG YTGYADSVKGRFTISRDNSKNTLYLQMN SLRAEDTAVYYCARSATWHDTALDYWGQ GTLVTVSS (SEQ ID NO: 4122) | DIQMTQSPSSLSASVGDRVTITCRASQSILSYVN WYQQKPGKAPKLLIYAATSRASGVPSRFSGSGSG TDFTLTISSLQPEDFATYYCQQSYSSPLTFGGGT KVEIK (SEQ ID NO: 4291) |
| 365_C07 | EVQLLESGGGLVQPGGSLRLSCAASGFT FSDYGMNWVRQAPGKGLEWVASINYNGG YTSYADSVKGRFTISRDNSKNTLYLQMN SLRAEDTAVYYCARSATWHDTALDYWGQ GTLVTVSS (SEQ ID NO: 4123) | DIQMTQSPSSLSASVGDRVTITCRASQSIVSYVN WYQQKPGKAPKLLIYAATSRASGVPSRFSGSGSG TDFTLTISSLQPEDFATYYCQQSYDTPLTFGGGT KVEIK (SEQ ID NO: 4292) |

TABLE 2F-continued

Group IV Antibody Sequences

| Ab | VH sequence | VL sequence |
| --- | --- | --- |
| 374_C08 | EVQLLESGGGLVQPGGSLRLSCAASGFT FDSYGMNWVRQAPGKGLEWVSGINYNSG YKSYADSVKGRFTISRDNSKNTLYLQMN SLRAEDTAVYYCARSATWHDTALDYWGQ GTLVTVSS (SEQ ID NO: 4124) | DIQMTQSPSSLSASVGDRVTITCRASQSILSYVN WYQQKPGKAPKLLIYAVTSRASGVPSRFSGSGSG TDFTLTISSLQPEDFATYYCQQSYDSPLTFGGGT KVEIK (SEQ ID NO: 4293) |
| 376_A06 | EVQLLESGGGLVQPGGSLRLSCAASGFT FDSYSMNWVRQAPGKGLEWVSGINYNSG YTSYADSVKGRFTISRDNSKNTLYLQMN SLRAEDTAVYYCARSATWHDTALDYWGQ GTLVTVSS (SEQ ID NO: 4125) | DIQMTQSPSSLSASVGDRVTITCRASQSILSYLN WYQQKPGKAPKLVIYYVSNRASGVPSRFSGSGSG TDFTLTISSLQPEDFATYYCQQSYDNPLTFGGGT KVEIK (SEQ ID NO: 4294) |
| 376_B07 | EVQLLESGGGLVQPGGSLRLSCAASGFT FDSYSMNWVRQAPGKGLEWVSGINYNSG YTSYADSVKGRFTISRDNSKNTLYLQMN SLRAEDTAVYYCARSATWHDTALDYWGQ GTLVTVSS (SEQ ID NO: 4126) | DIQMTQSPSSLSASVGDRVTITCRASQSILSYLN WYQQKPGKAPKLVIYYVSNRASGVPSRFSGSGSG TDFTLTISSLQPEDFATYYCQQSYDNPLTFGGGT KVEIK (SEQ ID NO: 4295) |
| 365_F07 | EVQLLESGGGLVQPGGSLRLSCAASGFT FSSYSMNWVRQAPGKGLEWVSNINYNGG YKSYADSVKGRFTISRDNSKNTLYLQMN SLRAEDTAVYYCARSATWHDTALDYWGQ GTLVTVSS (SEQ ID NO: 4127) | DIQMTQSPSSLSASVGDRVTITCRASQSILSYVN WYQQKPGKAPKLVIYAATSRASGVPSRFSGSGSG TDFTLTISSLQPEDFATYYCQQSYDLPLTFGGGT KVEIK (SEQ ID NO: 4296) |
| 369_E10 | EVQLLESGGGLVQPGGSLRLSCAASGFT FSSYSMNWVRQAPGKGLEWVSNINYNGG YKSYADSVKGRFTISRDNSKNTLYLQMN SLRAEDTAVYYCARSATWHDTALDYWGQ GTLVTVSS (SEQ ID NO: 4128) | DIQMTQSPSSLSASVGDRVTITCRASQSILSYVN WYQQKPGKAPKLVIYAATSRASGVPSRFSGSGSG TDFTLTISSLQPEDFATYYCQQSYDLPLTFGGGT KVEIK (SEQ ID NO: 4297) |
| 373_E03 | EVQLLESGGGLVQPGGSLRLSCAASGFT FDSYGMNWVRQAPGKGLEWVSNINYNGG YTGYADSVKGRFTISRDNSKNTLYLQMN SLRAEDTAVYYCARSATWHDTALDYWGQ GTLVTVSS (SEQ ID NO: 4129) | DIQMTQSPSSLSASVGDRVTITCRASQSILSYVN WYQQKPGKAPKLVIYAATSRASGVPSRFSGSGSG TDFTLTISSLQPEDFATYYCQQSYDLPLTFGGGT KVEIK (SEQ ID NO: 4298) |
| 366_B04 | EVQLLESGGGLVQPGGSLRLSCAASGFT FDSYSMNWVRQAPGKGLEWVAGINYNGG YKGYADSVKGRFTISRDNSKNTLYLQMN SLRAEDTAVYYCARSATWHDTHLDYWGQ GTLVTVSS (SEQ ID NO: 4130) | DIQMTQSPSSLSASVGDRVTITCRASQSILTYVN WYQQKPGKAPKLVIYAATSRHSGVPSRFSGSGSG TDFTLTISSLQPEDFATYYCQQSYDTPLTFGGGT KVEIK (SEQ ID NO: 4299) |
| 376_F12 | EVQLLESGGGLVQPGGSLRLSCAASGFT FDDYSMNWVRQAPGKGLEWVAGINYNGG YKSYADSVKGRFTISRDNSKNTLYLQMN SLRAEDTAVYYCARSATWHDTHLDYWGQ GTLVTVSS (SEQ ID NO: 4131) | DIQMTQSPSSLSASVGDRVTITCRASQSIISYVN WYQQKPGKAPKLLIYAASSLQSGVPSRFSGSGSG TDFTLTISSLQPEDFATYYCQQSYSTPLTFGGGT KVEIK (SEQ ID NO: 4300) |
| 369_F07 | EVQLLESGGGLVQPGGSLRLSCAASGFT FDSYSMNWVRQAPGKGLEWVAGINYNGG YKSYADSVKGRFTISRDNSKNTLYLQMN SLRAEDTAVYYCARSATWHDTHLDYWGQ GTLVTVSS (SEQ ID NO: 4132) | DIQMTQSPSSLSASVGDRVTITCRASQSILSYVN WYQQKPGKAPKLVIYAATSRASGVPSRFSGSGSG TDFTLTISSLQPEDFATYYCQQSYESPLTFGGGT KVEIK (SEQ ID NO: 4301) |
| 368_C06 | EVQLLESGGGLVQPGGSLRLSCAASGFT FDSYSMNWVRQAPGKGLEWVAGINYNGG YKSYADSVKGRFTISRDNSKNTLYLQMN SLRAEDTAVYYCARSATWHDTHLDYWGQ GTLVTVSS (SEQ ID NO: 4133) | DIQMTQSPSSLSASVGDRVTITCRASQSISSYLN WYQQKPGKAPKLIYAASSLQSGVPSRFSGSGSG TDFTLTISSLQPEDFATYYCQQSYSTPLTFGGGT KVEIK (SEQ ID NO: 4302) |
| 376_E12 | EVQLLESGGGLVQPGGSLRLSCAASGFT FSSYSMNWVRQAPGKGLEWVAGINYNGG YKSYADSVKGRFTISRDNSKNTLYLQMN SLRAEDTAVYYCARSATWHDTHLDYWGQ GTLVTVSS (SEQ ID NO: 4134) | DIQMTQSPSSLSASVGDRVTITCRASQSILSYLN WYQQKPGKAPKLLIYAASSLQSGVPSRFSGSGSG TDFTLTISSLQPEDFATYYCQQSYSTPLTFGGGT KVEIK (SEQ ID NO: 4303) |
| 371_H01 | EVQLLESGGGLVQPGGSLRLSCAASGFT FDSYSMNWVRQAPGKGLEWVAGINYNGG YTGYADSVKGRFTISRDNSKNTLYLQMN SLRAEDTAVYYCARSATWHDTHLDYWGQ GTLVTVSS (SEQ ID NO: 4135) | DIQMTQSPSSLSASVGDRVTITCRASQSIITYLN WYQQKPGKAPKLLIYAASSLQSGVPSRFSGSGSG TDFTLTISSLQPEDFATYYCQQSYSTPLTFGGGT KVEIK (SEQ ID NO: 4304) |

TABLE 2F-continued

Group IV Antibody Sequences

| Ab | VH sequence | VL sequence |
| --- | --- | --- |
| 367_E02 | EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4136) | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 4305) |
| 365_F04 | EVQLLESGGGLVQPGGSLRLSCAASGFTFSSYGMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4137) | DIQMTQSPSSLSASVGDRVTITCRASQSIVTYVNWYQQKPGKAPKLLIYAATSRASGVPSRFSGSGSGTDFTLTISSLQPEDFATYYCQQSYDTPLTFGGGTKVEIK (SEQ ID NO: 4306) |
| 370_A09 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4138) | DIQMTQSPSSLSASVGDRVTITCRASQSILTYLNWYQQKPGKAPKLVIYAATSRASGVPSRFSGSGSGTDFTLTISSLQPEDFATYYCQQSYDTPLTFGGGTKVEIK (SEQ ID NO: 4307) |
| 365_B03 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4139) | DIQMTQSPSSLSASVGDRVTITCRASQSIVSYLNWYQQKPGKAPKLLIYAATSRASGVPSRFSGSGSGTDFTLTISSLQPEDFATYYCQQSYENPLTFGGGTKVEIK (SEQ ID NO: 4308) |
| 369_A05 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4140) | DIQMTQSPSSLSASVGDRVTITCRASQSILTYVNWYQQKPGKAPKLVIYAATSRASGVPSRFSGSGSGTDFTLTISSLQPEDFATYYCQQSYESPLTFGGGTKVEIK (SEQ ID NO: 4309) |
| 373_H10 | EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSATWHDTHLDYWGQGTLVTVSS (SEQ ID NO: 4141) | DIQMTQSPSSLSASVGDRVTITCRASQSILSYVNWYQQKPGKAPKLLIYAATSRASGVPSRFSGSGSGTDFTLTISSLQPEDFATYYCQQSYSLPLTFGGGTKVEIK (SEQ ID NO: 4310) |
| 367_A09 | EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4142) | DIQMTQSPSSLSASVGDRVTITCRASQSILSYVNWYQQKPGKAPKLVIYAATSRHSGVPSRFSGSGSGTDFTLTISSLQPEDFATYYCQQSYDTPLTFGGGTKVEIK (SEQ ID NO: 4311) |
| 370_F08 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4143) | DIQMTQSPSSLSASVGDRVTITCRASQSIISYVNWYQQKPGKAPKLLIYAATSRHSGVPSRFSGSGSGTDFTLTISSLQPEDFATYYCQQSYNLPLTFGGGTKVEIK (SEQ ID NO: 4312) |
| 376_B01 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4144) | DIQMTQSPSSLSASVGDRVTITCRASQSILTYVNWYQQKPGKAPKLVIYAATSRASGVPSRFSGSGSGTDFTLTISSLQPEDFATYYCQQSYNLPLTFGGGTKVEIK (SEQ ID NO: 4313) |
| 365_D05 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4145) | DIQMTQSPSSLSASVGDRVTITCRASQSILTYVNWYQQKPGKAPKLLIYAATSRASGVPSRFSGSGSGTDFTLTISSLQPEDFATYYCQQSYNSPLTFGGGTKVEIK (SEQ ID NO: 4314) |
| 373_E04 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4146) | DIQMTQSPSSLSASVGDRVTITCRASQSILTYVNWYQQKPGKAPKLLIYAATSRASGVPSRFSGSGSGTDFTLTISSLQPEDFATYYCQQSYNSPLTFGGGTKVEIK (SEQ ID NO: 4315) |
| 368_G05 | EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS (SEQ ID NO: 4147) | DIQMTQSPSSLSASVGDRVTITCRASQSILTYVNWYQQKPGKAPKLLIYAATSLHSGVPSRFSGSGSGTDFTLTISSLQPEDFATYYCQQSYNTPLTFGGGTKVEIK (SEQ ID NO: 4316) |

TABLE 2F-continued

Group IV Antibody Sequences

| Ab | VH sequence | VL sequence |
|---|---|---|
| 365_A01 | EVQLLESGGGLVQPGGSLRLSCAASGFT FSDYGMNWVRQAPGKGLEWVAGINYNGG YTSYADSVKGRFTISRDNSKNTLYLQMN SLRAEDTAVYYCARSATWHDTHLDYWGQ GTLVTVSS (SEQ ID NO: 4148) | DIQMTQSPSSLSASVGDRVTITCRASQSILTYVN WYQQKPGKAPKLVIYATTSLASGVPSRFSGSGSG TDFTLTISSLQPEDFATYYCQQSYSTPLTFGGGT KVEIK (SEQ ID NO: 4317) |
| 373_H06 | EVQLLESGGGLVQPGGSLRLSCAASGFT FSSYGMHWVRQAPGKGLEWVAGINYNGG YTSYADSVKGRFTISRDNSKNTLYLQMN SLRAEDTAVYYCARSATWHDTHLDYWGQ GTLVTVSS (SEQ ID NO: 4149) | DIQMTQSPSSLSASVGDRVTITCRASQSIISYVN WYQQKPGKAPKLLIYAATSLASGVPSRFSGSGSG TDFTLTISSLQPEDFATYYCQQSYDLPLTFGGGT KVEIK (SEQ ID NO: 4318) |
| 369_G07 | EVQLLESGGGLVQPGGSLRLSCAASGFT FSSYSMNWVRQAPGKGLEWVAGINYNGG YTSYADSVKGRFTISRDNSKNTLYLQMN SLRAEDTAVYYCARSATWHDTHLDYWGQ GTLVTVSS (SEQ ID NO: 4150) | DIQMTQSPSSLSASVGDRVTITCRASQSILTYVN WYQQKPGKAPKLVIYAATSRASGVPSRFSGSGSG TDFTLTISSLQPEDFATYYCQQSYDNPLTFGGGT KVEIK (SEQ ID NO: 4319) |
| 373_G05 | EVQLLESGGGLVQPGGSLRLSCAASGFT FSSYSMNWVRQAPGKGLEWVAGINYNGG YTSYADSVKGRFTISRDNSKNTLYLQMN SLRAEDTAVYYCARSATWHDTHLDYWGQ GTLVTVSS (SEQ ID NO: 4151) | DIQMTQSPSSLSASVGDRVTITCRASQSILSYLN WYQQKPGKAPKLLIYAATSLASGVPSRFSGSGSG TDFTLTISSLQPEDFATYYCQQSYELPLTFGGGT KVEIK (SEQ ID NO: 4320) |
| 372_F07 | EVQLLESGGGLVQPGGSLRLSCAASGFT FDDYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4152) | DIQMTQSPSSLSASVGDRVTITCRASQSILTYLN WYQQKPGKAPKLVIYAATSRASGVPSRFSGSGSG TDFTLTISSLQPEDFATYYCQQSYELPLTFGGGT KVEIK (SEQ ID NO: 4321) |
| 370_H03 | EVQLLESGGGLVQPGGSLRLSCAASGFT FDSYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4153) | DIQMTQSPSSLSASVGDRVTITCRASQSILTYLN WYQQKPGKAPKLLIYAATSLASGVPSRFSGSGSG TDFTLTISSLQPEDFATYYCQQSYDTPLTFGGGT KVEIK (SEQ ID NO: 4322) |
| 366_A03 | EVQLLESGGGLVQPGGSLRLSCAASGFT FDSYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4154) | DIQMTQSPSSLSASVGDRVTITCRASQSISSYLN WYQQKPGKAPKLLIYAATSLASGVPSRFSGSGSG TDFTLTISSLQPEDFATYYCQQSYSNPLTFGGGT KVEIK (SEQ ID NO: 4323) |
| 365_A07 | EVQLLESGGGLVQPGGSLRLSCAASGFT FSSYGMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4155) | DIQMTQSPSSLSASVGDRVTITCRASQSIVSYLN WYQQKPGKAPKLLIYAATSRASGVPSRFSGSGSG TDFTLTISSLQPEDFATYYCQQSYNLPLTFGGGT KVEIK (SEQ ID NO: 4324) |
| 376_B06 | EVQLLESGGGLVQPGGSLRLSCAASGFT FSSYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4156) | DIQMTQSPSSLSASVGDRVTITCRASQSILTYLN WYQQKPGKAPKLLIYAATSRASGVPSRFSGSGSG TDFTLTISSLQPEDFATYYCQQSYDLPLTFGGGT KVEIK (SEQ ID NO: 4325) |
| 374_C11 | EVQLLESGGGLVQPGGSLRLSCAASGFT FSSYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4157) | DIQMTQSPSSLSASVGDRVTITCRASQSILTYLN WYQQKPGKAPKLLIYAATSRASGVPSRFSGSGSG TDFTLTISSLQPEDFATYYCQQSYESPLTFGGGT KVEIK (SEQ ID NO: 4326) |
| 375_A06 | EVQLLESGGGLVQPGGSLRLSCAASGFT FSSYSMNWVRQAPGKGLEWVAGINYNSG YKGYADSVKGRFTISRDNSKNTLYLQMN SLRAEDTAVYYCARSATWHDTHLDYWGQ GTLVTVSS (SEQ ID NO: 4158) | DIQMTQSPSSLSASVGDRVTITCRASQSILTYVN WYQQKPGKAPKLLIYAASSLQSGVPSRFSGSGSG TDFTLTISSLQPEDFATYYCQQSYSTPLTFGGGT KVEIK (SEQ ID NO: 4327) |
| 365_B09 | EVQLLESGGGLVQPGGSLRLSCAASGFT FDSYSMNWVRQAPGKGLEWVAGINYNSG YKSYADSVKGRFTISRDNSKNTLYLQMN SLRAEDTAVYYCARSATWHDTHLDYWGQ GTLVTVSS (SEQ ID NO: 4159) | DIQMTQSPSSLSASVGDRVTITCRASQSILRYLN WYQQKPGKAPKLLIYAATSLHSGVPSRFSGSGSG TDFTLTISSLQPEDFATYYCQQSYDNPLTFGGGT KVEIK (SEQ ID NO: 4328) |

TABLE 2F-continued

Group IV Antibody Sequences

| Ab | VH sequence | VL sequence |
|---|---|---|
| 373_E06 | EVQLLESGGGLVQPGGSLRLSCAASGFTFDSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4160) | DIQMTQSPSSLSASVGDRVTITCRASQSILRYLNWYQQKPGKAPKLLIYAATSLHSGVPSRFSGSGSGTDFTLTISSLQPEDFATYYCQQSYDNPLTFGGGTKVEIK (SEQ ID NO: 4329) |
| 374_C05 | EVQLLESGGGLVQPGGSLRLSCAASGFTFDSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4161) | DIQMTQSPSSLSASVGDRVTITCRASQSIIRYLNWYQQKPGKAPKLVIYAATSRASGVPSRFSGSGSGTDFTLTISSLQPEDFATYYCQQSYDNPLTFGGGTKVEIK (SEQ ID NO: 4330) |
| 376_C11 | EVQLLESGGGLVQPGGSLRLSCAASGFTFDSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4162) | DIQMTQSPSSLSASVGDRVTITCRASQSILTYLNWYQQKPGKAPKLVIYAATSRASGVPSRFSGSGSGTDFTLTISSLQPEDFATYYCQQSYDNPLTFGGGTKVEIK (SEQ ID NO: 4331) |
| 373_C09 | EVQLLESGGGLVQPGGSLRLSCAASGFTFDSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4163) | DIQMTQSPSSLSASVGDRVTITCRASQSILTYLNWYQQKPGKAPKLVIYAATSRASGVPSRFSGSGSGTDFTLTISSLQPEDFATYYCQQSYELPLTFGGGTKVEIK (SEQ ID NO: 4332) |
| 368_H01 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4164) | DIQMTQSPSSLSASVGDRVTITCRASQSILSYLNWYQQKPGKAPKLLIYATTSLASGVPSRFSGSGSGTDFTLTISSLQPEDFATYYCQQSYDNPLTFGGGTKVEIK (SEQ ID NO: 4333) |
| 373_B03 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4165) | DIQMTQSPSSLSASVGDRVTITCRASQSILTYLNWYQQKPGKAPKLVIYAATSLASGVPSRFSGSGSGTDFTLTISSLQPEDFATYYCQQSYDNPLTFGGGTKVEIK (SEQ ID NO: 4334) |
| 374_C04 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4166) | DIQMTQSPSSLSASVGDRVTITCRASQSILTYLNWYQQKPGKAPKLLIYAASSLQSGVPSRFSGSGSGTDFTLTISSLQPEDFATYYCQQSYELPLTFGGGTKVEIK (SEQ ID NO: 4335) |
| 371_F05 | EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSATWHDTHLDYWGQGTLVTVSS (SEQ ID NO: 4167) | DIQMTQSPSSLSASVGDRVTITCRASQSILSYLNWYQQKPGKAPKLLIYAATSRHSGVPSRFSGSGSGTDFTLTISSLQPEDFATYYCQQSYENPLTFGGGTKVEIK (SEQ ID NO: 4336) |
| 369_A10 | EVQLLESGGGLVQPGGSLRLSCAASGFTFDSYSMNWVRQAPGKGLEWVAGINYNSGYTGYADSVKGRFTISRDNSKNTLYLQMNSLRAEDTAVYYCARSATWHDTHLDYWGQGTLVTVSS (SEQ ID NO: 4168) | DIQMTQSPSSLSASVGDRVTITCRASQSILSYLNWYQQKPGKAPKLLIYAATSRASGVPSRFSGSGSGTDFTLTISSLQPEDFATYYCQQSYELPLTFGGGTKVEIK (SEQ ID NO: 4337) |
| 366_A05 | EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARSATWHDTHLDYWGQGTLVTVSS (SEQ ID NO: 4169) | DIQMTQSPSSLSASVGDRVTITCRASQSILTYVNWYQQKPGKAPKLVIYAATSLASGVPSRFSGSGSGTDFTLTISSLQPEDFATYYCQQSYNTPLTFGGGTKVEIK (SEQ ID NO: 4338) |
| 375_G07 | EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSATWHDTHLDYWGQGTLVTVSS (SEQ ID NO: 4170) | DIQMTQSPSSLSASVGDRVTITCRASQSILSYLNWYQQKPGKAPKLVIYAATSLASGVPSRFSGSGSGTDFTLTISSLQPEDFATYYCQQSYDLPLTFGGGTKVEIK (SEQ ID NO: 4339) |
| 374_D02 | EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSATWHDTHLDYWGQGTLVTVSS (SEQ ID NO: 4171) | DIQMTQSPSSLSASVGDRVTITCRASQSISTYVNWYQQKPGKAPKLLIYAVTSLASGVPSRFSGSGSGTDFTLTISSLQPEDFATYYCQQSYDSPLTFGGGTKVEIK (SEQ ID NO: 4340) |

TABLE 2F-continued

Group IV Antibody Sequences

| Ab | VH sequence | VL sequence |
|---|---|---|
| 365_A10 | EVQLLESGGGLVQPGGSLRLSCAASGFT FSSYGMHWVRQAPGKGLEWVAGINYNSG YTSYADSVKGRFTISRDNSKNTLYLQMN SLRAEDTAVYYCARSATWHDTHLDYWGQ GTLVTVSS (SEQ ID NO: 4172) | DIQMTQSPSSLSASVGDRVTITCRASQSILTYLN WYQQKPGKAPKLVIYAVTSLASGVPSRFSGSGSG TDFTLTISSLQPEDFATYYCQQSYDSPLTFGGGT KVEIK (SEQ ID NO: 4341) |
| 375_A02 | EVQLLESGGGLVQPGGSLRLSCAASGFT FSSYSMNWVRQAPGKGLEWVAGINYNSG YTSYADSVKGRFTISRDNSKNTLYLQMN SLRAEDTAVYYCARSATWHDTHLDYWGQ GTLVTVSS (SEQ ID NO: 4173) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 4342) |
| 371_G03 | EVQLLESGGGLVQPGGSLRLSCAASGFT FSSYGMNWVRQAPGKGLEWVANINYNGG YKGYADSVKGRFTISRDNSKNTLYLQMN SLRAEDTAVYYCARSATWHDTHLDYWGQ GTLVTVSS (SEQ ID NO: 4174) | DIQMTQSPSSLSASVGDRVTITCRASQSIVTYVN WYQQKPGKAPKLVIYAATSLASGVPSRFSGSGSG TDFTLTISSLQPEDFATYYCQQSYNLPLTFGGGT KVEIK (SEQ ID NO: 4343) |
| 370_E07 | EVQLLESGGGLVQPGGSLRLSCAASGFT FDSYSMNWVRQAPGKGLEWVANINYNGG YTGYADSVKGRFTISRDNSKNTLYLQMN SLRAEDTAVYYCARSATWHDTHLDYWGQ GTLVTVSS (SEQ ID NO: 4175) | DIQMTQSPSSLSASVGDRVTITCRASQSILTYLN WYQQKPGKAPKLLIYAATSRASGVPSRFSGSGSG TDFTLTISSLQPEDFATYYCQQSYDNPLTFGGGT KVEIK (SEQ ID NO: 4344) |
| 375_B04 | EVQLLESGGGLVQPGGSLRLSCAASGFT FDSYSMNWVRQAPGKGLEWVANINYNGG YTGYADSVKGRFTISRDNSKNTLYLQMN SLRAEDTAVYYCARSATWHDTHLDYWGQ GTLVTVSS (SEQ ID NO: 4176) | DIQMTQSPSSLSASVGDRVTITCRASQSILTYLN WYQQKPGKAPKLLIYAATSRASGVPSRFSGSGSG TDFTLTISSLQPEDFATYYCQQSYDNPLTFGGGT KVEIK (SEQ ID NO: 4345) |
| 367_G07 | EVQLLESGGGLVQPGGSLRLSCAASGFT FDSYSMNWVRQAPGKGLEWVANINYNGG YTGYADSVKGRFTISRDNSKNTLYLQMN SLRAEDTAVYYCARSATWHDTHLDYWGQ GTLVTVSS (SEQ ID NO: 4177) | DIQMTQSPSSLSASVGDRVTITCRASQSILTYVN WYQQKPGKAPKLLIYAATSRASGVPSRFSGSGSG TDFTLTISSLQPEDFATYYCQQSYDNPLTFGGGT KVEIK (SEQ ID NO: 4346) |
| 366_C02 | EVQLLESGGGLVQPGGSLRLSCAASGFT FSDYSMNWVRQAPGKGLEWVANINYNGG YTGYADSVKGRFTISRDNSKNTLYLQMN SLRAEDTAVYYCARSATWHDTHLDYWGQ GTLVTVSS (SEQ ID NO: 4178) | DIQMTQSPSSLSASVGDRVTITCRASQSIVSYLN WYQQKPGKAPKLLIYAATSRASGVPSRFSGSGSG TDFTLTISSLQPEDFATYYCQQSYDNPLTFGGGT KVEIK (SEQ ID NO: 4347) |
| 375_C12 | EVQLLESGGGLVQPGGSLRLSCAASGFT FSSYSMNWVRQAPGKGLEWVANINYNGG YTGYADSVKGRFTISRDNSKNTLYLQMN SLRAEDTAVYYCARSATWHDTHLDYWGQ GTLVTVSS (SEQ ID NO: 4179) | DIQMTQSPSSLSASVGDRVTITCRASQSILTYLN WYQQKPGKAPKLLIYAATSRASGVPSRFSGSGSG TDFTLTISSLQPEDFATYYCQQSYDLPLTFGGGT KVEIK (SEQ ID NO: 4348) |
| 365_F08 | EVQLLESGGGLVQPGGSLRLSCAASGFT FDDYGMNWVRQAPGKGLEWVANINYNGG YTSYADSVKGRFTISRDNSKNTLYLQMN SLRAEDTAVYYCARSATWHDTHLDYWGQ GTLVTVSS (SEQ ID NO: 4180) | DIQMTQSPSSLSASVGDRVTITCRASQSILSYVN WYQQKPGKAPKLLIYAATSRHSGVPSRFSGSGSG TDFTLTISSLQPEDFATYYCQQSYSLPLTFGGGT KVEIK (SEQ ID NO: 4349) |
| 368_G09 | EVQLLESGGGLVQPGGSLRLSCAASGFT FDSYGMHWVRQAPGKGLEWVANINYNGG YTSYADSVKGRFTISRDNSKNTLYLQMN SLRAEDTAVYYCARSATWHDTHLDYWGQ GTLVTVSS (SEQ ID NO: 4181) | DIQMTQSPSSLSASVGDRVTITCRASQSIVSYLN WYQQKPGKAPKLVIYAATSRASGVPSRFSGSGSG TDFTLTISSLQPEDFATYYCQQSYDTPLTFGGGT KVEIK (SEQ ID NO: 4350) |
| 368_E11 | EVQLLESGGGLVQPGGSLRLSCAASGFT FDSYGMHWVRQAPGKGLEWVANINYNGG YTSYADSVKGRFTISRDNSKNTLYLQMN SLRAEDTAVYYCARSATWHDTHLDYWGQ GTLVTVSS (SEQ ID NO: 4182) | DIQMTQSPSSLSASVGDRVTITCRASQSIISYVN WYQQKPGKAPKLLIYAATSRHSGVPSRFSGSGSG TDFTLTISSLQPEDFATYYCQQSYELPLTFGGGT KVEIK (SEQ ID NO: 4351) |
| 367_F02 | EVQLLESGGGLVQPGGSLRLSCAASGFT FDSYSMNWVRQAPGKGLEWVANINYNGG YTSYADSVKGRFTISRDNSKNTLYLQMN SLRAEDTAVYYCARSATWHDTHLDYWGQ GTLVTVSS (SEQ ID NO: 4183) | DIQMTQSPSSLSASVGDRVTITCRASQSIISYVN WYQQKPGKAPKLLIYAATSRHSGVPSRFSGSGSG TDFTLTISSLQPEDFATYYCQQSYESPLTFGGGT KVEIK (SEQ ID NO: 4352) |

TABLE 2F-continued

Group IV Antibody Sequences

| Ab | VH sequence | VL sequence |
|---|---|---|
| 373_B08 | EVQLLESGGGLVQPGGSLRLSCAASGFT FDSYSMNWVRQAPGKGLEWVANINYNSG YKGYADSVKGRFTISRDNSKNTLYLQMN SLRAEDTAVYYCARSATWHDTHLDYWGQ GTLVTVSS (SEQ ID NO: 4184) | DIQMTQSPSSLSASVGDRVTITCRASQSILTYLN WYQQKPGKAPKLVIYAATSLASGVPSRFSGSGSG TDFTLTISSLQPEDFATYYCQQSYENPLTFGGGT KVEIK (SEQ ID NO: 4353) |
| 374_A11 | EVQLLESGGGLVQPGGSLRLSCAASGFT FSDYSMNWVRQAPGKGLEWVANINYNSG YKGYADSVKGRFTISRDNSKNTLYLQMN SLRAEDTAVYYCARSATWHDTHLDYWGQ GTLVTVSS (SEQ ID NO: 4185) | DIQMTQSPSSLSASVGDRVTITCRASQSILSYVN WYQQKPGKAPKLVIYAATSRASGVPSRFSGSGSG TDFTLTISSLQPEDFATYYCQQSYSSPLTFGGGT KVEIK (SEQ ID NO: 4354) |
| 373_B11 | EVQLLESGGGLVQPGGSLRLSCAASGFT FSSYSMNWVRQAPGKGLEWVANINYNSG YKGYADSVKGRFTISRDNSKNTLYLQMN SLRAEDTAVYYCARSATWHDTHLDYWGQ GTLVTVSS (SEQ ID NO: 4186) | DIQMTQSPSSLSASVGDRVTITCRASQSILSYLN WYQQKPGKAPKLLIYAATSRASGVPSRFSGSGSG TDFTLTISSLQPEDFATYYCQQSYDNPLTFGGGT KVEIK (SEQ ID NO: 4355) |
| 373_F03 | EVQLLESGGGLVQPGGSLRLSCAASGFT FDSYSMNWVRQAPGKGLEWVANINYNSG YTGYADSVKGRFTISRDNSKNTLYLQMN SLRAEDTAVYYCARSATWHDTHLDYWGQ GTLVTVSS (SEQ ID NO: 4187) | DIQMTQSPSSLSASVGDRVTITCRASQSILTYVN WYQQKPGKAPKLLIYAATSRHSGVPSRFSGSGSG TDFTLTISSLQPEDFATYYCQQSYDSPLTFGGGT KVEIK (SEQ ID NO: 4356) |
| 372_D04 | EVQLLESGGGLVQPGGSLRLSCAASGFT FSSYSMNWVRQAPGKGLEWVANINYNSG YTGYADSVKGRFTISRDNSKNTLYLQMN SLRAEDTAVYYCARSATWHDTHLDYWGQ GTLVTVSS (SEQ ID NO: 4188) | DIQMTQSPSSLSASVGDRVTITCRASQSILTYLN WYQQKPGKAPKLLIYAATSLHSGVPSRFSGSGSG TDFTLTISSLQPEDFATYYCQQSYDLPLTFGGGT KVEIK (SEQ ID NO: 4357) |
| 366_C01 | EVQLLESGGGLVQPGGSLRLSCAASGFT FSDYGMNWVRQAPGKGLEWVASINYNGG YTGYADSVKGRFTISRDNSKNTLYLQMN SLRAEDTAVYYCARSATWHDTHLDYWGQ GTLVTVSS (SEQ ID NO: 4189) | DIQMTQSPSSLSASVGDRVTITCRASQSIVTYLN WYQQKPGKAPKLLIYAATSPASGVPSRFSGSGSG TDFTLTISSLQPEDFATYYCQQSYELPLTFGGGT KVEIK (SEQ ID NO: 4358) |
| 367_A01 | EVQLLESGGGLVQPGGSLRLSCAASGFT FSSYSMNWVRQAPGKGLEWVASINYNGG YTGYADSVKGRFTISRDNSKNTLYLQMN SLRAEDTAVYYCARSATWHDTHLDYWGQ GTLVTVSS (SEQ ID NO: 4190) | DIQMTQSPSSLSASVGDRVTITCRASQSILTYLN WYQQKPGKAPKLLIYAATSRASGVPSRFSGSGSG TDFTLTISSLQPEDFATYYCQQSYDLPLTFGGGT KVEIK (SEQ ID NO: 4359) |
| 366_H05 | EVQLLESGGGLVQPGGSLRLSCAASGFT FDSYGMHWVRQAPGKGLEWVASINYNGG YTSYADSVKGRFTISRDNSKNTLYLQMN SLRAEDTAVYYCARSATWHDTHLDYWGQ GTLVTVSS (SEQ ID NO: 4191) | DIQMTQSPSSLSASVGDRVTITCRASQSILSYVN WYQQKPGKAPKLLIYAATSLASGVPSRFSGSGSG TDFTLTISSLQPEDFATYYCQQSYDLPLTFGGGT KVEIK (SEQ ID NO: 4360) |
| 369_B09 | EVQLLESGGGLVQPGGSLRLSCAASGFT FDSYGMHWVRQAPGKGLEWVASINYNGG YTSYADSVKGRFTISRDNSKNTLYLQMN SLRAEDTAVYYCARSATWHDTHLDYWGQ GTLVTVSS (SEQ ID NO: 4192) | DIQMTQSPSSLSASVGDRVTITCRASQSILTYLN WYQQKPGKAPKLLIYAATSRASGVPSRFSGSGSG TDFTLTISSLQPEDFATYYCQQSYENPLTFGGGT KVEIK (SEQ ID NO: 4361) |
| 366_D07 | EVQLLESGGGLVQPGGSLRLSCAASGFT FSDYGMHWVRQAPGKGLEWVASINYNGG YTSYADSVKGRFTISRDNSKNTLYLQMN SLRAEDTAVYYCARSATWHDTHLDYWGQ GTLVTVSS (SEQ ID NO: 4193) | DIQMTQSPSSLSASVGDRVTITCRASQSILTYLN WYQQKPGKAPKLLIYAATSLASGVPSRFSGSGSG TDFTLTISSLQPEDFATYYCQQSYSSPLTFGGGT KVEIK (SEQ ID NO: 4362) |
| 369_D11 | EVQLLESGGGLVQPGGSLRLSCAASGFT FSSYGMHWVRQAPGKGLEWVASINYNGG YTSYADSVKGRFTISRDNSKNTLYLQMN SLRAEDTAVYYCARSATWHDTHLDYWGQ GTLVTVSS (SEQ ID NO: 4194) | DIQMTQSPSSLSASVGDRVTITCRASQSILTYLN WYQQKPGKAPKLVIYAATSLASGVPSRFSGSGSG TDFTLTISSLQPEDFATYYCQQSDELPLTFGGGT KVEIK (SEQ ID NO: 4363) |
| 370_B05 | EVQLLESGGGLVQPGGSLRLSCAASGFT FSSYGMNWVRQAPGKGLEWVASINYNGG YTSYADSVKGRFTISRDNSKNTLYLQMN SLRAEDTAVYYCARSATWHDTHLDYWGQ GTLVTVSS (SEQ ID NO: 4195) | DIQMTQSPSSLSASVGDRVTITCRASQSILTYVN WYQQKPGKAPKLVIYAATSRASGVPSRFSGSGSG TDFTLTISSLQPEDFATYYCQQSYENPLTFGGGT KVEIK (SEQ ID NO: 4364) |

TABLE 2F-continued

Group IV Antibody Sequences

| Ab | VH sequence | VL sequence |
| --- | --- | --- |
| 366_D02 | EVQLLESGGGLVQPGGSLRLSCAASGFTFSSYSMNWVRQAPGKGLEWVASINYGGYTSYADSVKGRFTISRDNSKNTLYLQMNSLRAEDTAVYYCARSATWHDTHLDYWGQGTLVTVSS (SEQ ID NO: 4196) | DIQMTQSPSSLSASVGDRVTITCRASQSILSYVNWYQQKPGKAPKLLIYATTSLASGVPSRFSGSGSGTDFTLTISSLQPEDFATYYCQQSYDLPLTFGGGTKVEIK (SEQ ID NO: 4365) |
| 368_H12 | EVQLLESGGGLVQPGGSLRLSCAASGFTFDSYSMNWVRQAPGKGLEWVASINYNSGYKGYADSVKGRFTISRDNSKNTLYLQMNSLRAEDTAVYYCARSATWHDTHLDYWGQGTLVTVSS (SEQ ID NO: 4197) | DIQMTQSPSSLSASVGDRVTITCRASQSIVTYLNWYQQKPGKAPKLLIYAATSRASGVPSRFSGSGSGTDFTLTISSLQPEDFATYYCQQSYESPLTFGGGTKVEIK (SEQ ID NO: 4366) |
| 368_F12 | EVQLLESGGGLVQPGGSLRLSCAASGFTFDDYSMNWVRQAPGKGLEWVASINYNSGYKSYADSVKGRFTISRDNSKNTLYLQMNSLRAEDTAVYYCARSATWHDTHLDYWGQGTLVTVSS (SEQ ID NO: 4198) | DIQMTQSPSSLSASVGDRVTITCRASQSIVTYLNWYQQKPGKAPKLVIYAATSLASGVPSRFSGSGSGTDFTLTISSLQPEDFATYYCQQSYDLPLTFGGGTKVEIK (SEQ ID NO: 4367) |
| 370_A06 | EVQLLESGGGLVQPGGSLRLSCAASGFTFSSYSMNWVRQAPGKGLEWVASINYNSGYKSYADSVKGRFTISRDNSKNTLYLQMNSLRAEDTAVYYCARSATWHDTHLDYWGQGTLVTVSS (SEQ ID NO: 4199) | DIQMTQSPSSLSASVGDRVTITCRASQSIVTYLNWYQQKPGKAPKLVIYAATSLASGVPSRFSGSGSGTDFTLTISSLQPEDFATYYCQQSYDLPLTFGGGTKVEIK (SEQ ID NO: 4368) |
| 369_F12 | EVQLLESGGGLVQPGGSLRLSCAASGFTFSSYSMNWVRQAPGKGLEWVASINYNSGYKSYADSVKGRFTISRDNSKNTLYLQMNSLRAEDTAVYYCARSATWHDTHLDYWGQGTLVTVSS (SEQ ID NO: 4200) | DIQMTQSPSSLSASVGDRVTITCRASQSIISYLNWYQQKPGKAPKLLIYAVTSLASGVPSRFSGSGSGTDFTLTISSLQPEDFATYYCQQSYENPLTFGGGTKVEIK (SEQ ID NO: 4369) |
| 366_A09 | EVQLLESGGGLVQPGGSLRLSCAASGFTFSDYGMHWVRQAPGKGLEWVASINYNSGYTSYADSVKGRFTISRDNSKNTLYLQMNSLRAEDTAVYYCARSATWHDTHLDYWGQGTLVTVSS (SEQ ID NO: 4201) | DIQMTQSPSSLSASVGDRVTITCRASQSILTYLNWYQQKPGKAPKLLIYAATSRHSGVPSRFSGSGSGTDFTLTISSLQPEDFATYYCQQSYETPLTFGGGTKVEIK (SEQ ID NO: 4370) |
| 368_H07 | EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARSATWHDTHLDYWGQGTLVTVSS (SEQ ID NO: 4202) | DIQMTQSPSSLSASVGDRVTITCRASQSILSYLNWYQQKPGKAPKLLIYAATSRASGVPSRFSGSGSGTDFTLTISSLQPEDFATYYCQQSYENPLTFGGGTKVEIK (SEQ ID NO: 4371) |
| 370_C04 | EVQLLESGGGLVQPGGSLRLSCAASGFTFSSYGMNWVRQAPGKGLEWVASINYNSGYTSYADSVKGRFTISRDNSKNTLYLQMNSLRAEDTAVYYCARSATWHDTHLDYWGQGTLVTVSS (SEQ ID NO: 4203) | DIQMTQSPSSLSASVGDRVTITCRASQSILSYLNWYQQKPGKAPKLLIYAASSLQSGVPSRFSGSGSGTDFTLTISSLQPEDFATYYCQQSYENPLTFGGGTKVEIK (SEQ ID NO: 4372) |
| 373_E02 | EVQLLESGGGLVQPGGSLRLSCAASGFTFDSYGMHWVRQAPGKGLEWVSGINYNGGYKGYADSVKGRFTISRDNSKNTLYLQMNSLRAEDTAVYYCARSATWHDTHLDYWGQGTLVTVSS (SEQ ID NO: 4204) | DIQMTQSPSSLSASVGDRVTITCRASQSIVRYLNWYQQKPGKAPKLLIYAASSLQSGVPSRFSGSGSGTDFTLTISSLQPEDFATYYCQQSYSTPLTFGGGTKVEIK (SEQ ID NO: 4373) |
| 374_E09 | EVQLLESGGGLVQPGGSLRLSCAASGFTFSDYSMNWVRQAPGKGLEWVSGINYNGGYKGYADSVKGRFTISRDNSKNTLYLQMNSLRAEDTAVYYCARSATWHDTHLDYWGQGTLVTVSS (SEQ ID NO: 4205) | DIQMTQSPSSLSASVGDRVTITCRASQSIVTYLNWYQQKPGKAPKLLIYAATSRASGVPSRFSGSGSGTDFTLTISSLQPEDFATYYCQQSYDSPLTFGGGTKVEIK (SEQ ID NO: 4374) |
| 371_C09 | EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARSATWHDTHLDYWGQGTLVTVSS (SEQ ID NO: 4206) | DIQMTQSPSSLSASVGDRVTITCRASQSILTYVNWYQQKPGKAPKLLIYAASSLQSGVPSRFSGSGSGTDFTLTISSLQPEDFATYYCQQSYDNPLTFGGGTKVEIK (SEQ ID NO: 4375) |
| 369_B12 | EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARSATWHDTHLDYWGQGTLVTVSS (SEQ ID NO: 4207) | DIQMTQSPSSLSASVGDRVTITCRASQSILTYVNWYQQKPGKAPKLLIYATTSLASGVPSRFSGSGSGTDFTLTISSLQPEDFATYYCQQSYDSPLTFGGGTKVEIK (SEQ ID NO: 4376) |

TABLE 2F-continued

Group IV Antibody Sequences

| Ab | VH sequence | VL sequence |
|---|---|---|
| 369_B02 | EVQLLESGGGLVQPGGSLRLSCAASGFT FDSYSMNWVRQAPGKGLEWVSGINYNGG YKSYADSVKGRFTISRDNSKNTLYLQMN SLRAEDTAVYYCARSATWHDTHLDYWGQ GTLVTVSS (SEQ ID NO: 4208) | DIQMTQSPSSLSASVGDRVTITCRASQSILSYLN WYQQKPGKAPKLVIYAATSRASGVPSRFSGSGSG TDFTLTISSLQPEDFATYYCQQSYNLPLTFGGGT KVEIK (SEQ ID NO: 4377) |
| 365_C09 | EVQLLESGGGLVQPGGSLRLSCAASGFT FSDYGMNWVRQAPGKGLEWVSGINYNGG YKSYADSVKGRFTISRDNSKNTLYLQMN SLRAEDTAVYYCARSATWHDTHLDYWGQ GTLVTVSS (SEQ ID NO: 4209) | DIQMTQSPSSLSASVGDRVTITCRASQSIVSYVN WYQQKPGKAPKLLIYAATSRASGVPSRFSGSGSG TDFTLTISSLQPEDFATYYCQQSYDTPLTFGGGT KVEIK (SEQ ID NO: 4378) |
| 374_B09 | EVQLLESGGGLVQPGGSLRLSCAASGFT FSSYSMNWVRQAPGKGLEWVSGINYNGG YKSYADSVKGRFTISRDNSKNTLYLQMN SLRAEDTAVYYCARSATWHDTHLDYWGQ GTLVTVSS (SEQ ID NO: 4210) | DIQMTQSPSSLSASVGDRVTITCRASQSIVRYLN WYQQKPGKAPKLVIYAATSLASGVPSRFSGSGSG TDFTLTISSLQPEDFATYYCQQSYELPLTFGGGT KVEIK (SEQ ID NO: 4379) |
| 374_D12 | EVQLLESGGGLVQPGGSLRLSCAASGFT FDSYSMNWVRQAPGKGLEWVSGINYNGG YTGYADSVKGRFTISRDNSKNTLYLQMN SLRAEDTAVYYCARSATWHDTHLDYWGQ GTLVTVSS (SEQ ID NO: 4211) | DIQMTQSPSSLSASVGDRVTITCRASQSIVSYVN WYQQKPGKAPKLVIYAATSRASGVPSRFSGSGSG TDFTLTISSLQPEDFATYYCQQSYDLPLTFGGGT KVEIK (SEQ ID NO: 4380) |
| 374_C02 | EVQLLESGGGLVQPGGSLRLSCAASGFT FDSYSMNWVRQAPGKGLEWVSGINYNGG YTGYADSVKGRFTISRDNSKNTLYLQMN SLRAEDTAVYYCARSATWHDTHLDYWGQ GTLVTVSS (SEQ ID NO: 4212) | DIQMTQSPSSLSASVGDRVTITCRASQSILSYLN WYQQKPGKAPKLLIYAATSRHSGVPSRFSGSGSG TDFTLTISSLQPEDFATYYCQQSYDSPLTFGGGT KVEIK (SEQ ID NO: 4381) |
| 374_H08 | EVQLLESGGGLVQPGGSLRLSCAASGFT FDSYSMNWVRQAPGKGLEWVSGINYNGG YTGYADSVKGRFTISRDNSKNTLYLQMN SLRAEDTAVYYCARSATWHDTHLDYWGQ GTLVTVSS (SEQ ID NO: 4213) | DIQMTQSPSSLSASVGDRVTITCRASQSILSYLN WYQQKPGKAPKLLIYAATSLHSGVPSRFSGSGSG TDFTLTISSLQPEDFATYYCQQSYENPLTFGGGT KVEIK (SEQ ID NO: 4382) |
| 369_D06 | EVQLLESGGGLVQPGGSLRLSCAASGFT FDSYSMNWVRQAPGKGLEWVSGINYNGG YTGYADSVKGRFTISRDNSKNTLYLQMN SLRAEDTAVYYCARSATWHDTHLDYWGQ GTLVTVSS (SEQ ID NO: 4214) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 4383) |
| 366_B06 | EVQLLESGGGLVQPGGSLRLSCAASGFT FDSYSMNWVRQAPGKGLEWVSGINYNGG YTSYADSVKGRFTISRDNSKNTLYLQMN SLRAEDTAVYYCARSATWHDTHLDYWGQ GTLVTVSS (SEQ ID NO: 4215) | DIQMTQSPSSLSASVGDRVTITCRASQSILTYVN WYQQKPGKAPKLVIYAAPSLASGVPSRFSGSGSG TDFTLTISSLQPEDFATYYCQQSYXTPLTFGGGT KVEIK (SEQ ID NO: 4384) |
| 367_A11 | EVQLLESGGGLVQPGGSLRLSCAASGFT FSSYGMHWVRQAPGKGLEWVSGINYNGG YTSYADSVKGRFTISRDNSKNTLYLQMN SLRAEDTAVYYCARSATWHDTHLDYWGQ GTLVTVSS (SEQ ID NO: 4216) | DIQMTQSPSSLSASVGDRVTITCRASQSILSYVN WYQQKPGKAPKLVIYATTSLASGVPSRFSGSGSG TDFTLTISSLQPEDFATYYCQQSYNSPLTFGGGT KVEIK (SEQ ID NO: 4385) |
| 369_F04 | EVQLLESGGGLVQPGGSLRLSCAASGFT FSSYGMNWVRQAPGKGLEWVSGINYNGG YTSYADSVKGRFTISRDNSKNTLYLQMN SLRAEDTAVYYCARSATWHDTHLDYWGQ GTLVTVSS (SEQ ID NO: 4217) | DIQMTQSPSSLSASVGDRVTITCRASQSIISYVN WYQQKPGKAPKLVIYAATSRHSGVPSRFSGSGSG TDFTLTISSLQPEDFATYYCQQSYDNPLTFGGGT KVEIK (SEQ ID NO: 4386) |
| 369_A01 | EVQLLESGGGLVQPGGSLRLSCAASGFT FDSYSMNWVRQAPGKGLEWVSGINYNSG YKGYADSVKGRFTISRDNSKNTLYLQMN SLRAEDTAVYYCARSATWHDTHLDYWGQ GTLVTVSS (SEQ ID NO: 4218) | DIQMTQSPSSLSASVGDRVTITCRASQSILTYVN WYQQKPGKAPKLVIYAATSLASGVPSRFSGSGSG TDFTLTISSLQPEDFATYYCQQSYELPLTFGGGT KVEIK (SEQ ID NO: 4387) |
| 373_H12 | EVQLLESGGGLVQPGGSLRLSCAASGFT FSDYSMNWVRQAPGKGLEWVSGINYNSG YKGYADSVKGRFTISRDNSKNTLYLQMN SLRAEDTAVYYCARSATWHDTHLDYWGQ GTLVTVSS (SEQ ID NO: 4219) | DIQMTQSPSSLSASVGDRVTITCRASQSILTYLN WYQQKPGKAPKLLIYAATSRASGVPSRFSGSGSG TDFTLTISSLQPEDFATYYCQQSYNSPLTFGGGT KVEIK (SEQ ID NO: 4388) |

TABLE 2F-continued

Group IV Antibody Sequences

| Ab | VH sequence | VL sequence |
|---|---|---|
| 376_C07 | EVQLLESGGGLVQPGGSLRLSCAASGFT FSSYSMNWVRQAPGKGLEWVSGINYNSG YKGYADSVKGRFTISRDNSKNTLYLQMN SLRAEDTAVYYCARSATWHDTHLDYWGQ GTLVTVSS (SEQ ID NO: 4220) | DIQMTQSPSSLSASVGDRVTITCRASQSILSYVN WYQQKPGKAPKLLIYAATSRHSGVPSRFSGSGSG TDFTLTISSLQPEDFATYYCQQSYDLPLTFGGGT KVEIK (SEQ ID NO: 4389) |
| 366_E02 | EVQLLESGGGLVQPGGSLRLSCAASGFT FSSYSMNWVRQAPGKGLEWVSGINYNSG YKGYADSVKGRFTISRDNSKNTLYLQMN SLRAEDTAVYYCARSATWHDTHLDYWGQ GTLVTVSS (SEQ ID NO: 4221) | DIQMTQSPSSLSASVGDRVTITCRASQSISSYLN WYQQKPGKAPKLLIYAASSLQSGVPSRFSGSGSG TDFTLTISSLQPEDFATYYCQQSYNSPLTFGGGT KVEIK (SEQ ID NO: 4390) |
| 376_G01 | EVQLLESGGGLVQPGGSLRLSCAASGFT FDDYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4222) | DIQMTQSPSSLSASVGDRVTITCRASQSILSYVN WYQQKPGKAPKLVIYAVTSRASGVPSRFSGSGSG TDFTLTISSLQPEDFATYYCQQSYELPLTFGGGT KVEIK (SEQ ID NO: 4391) |
| 373_F02 | EVQLLESGGGLVQPGGSLRLSCAASGFT FDSYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4223) | DIQMTQSPSSLSASVGDRVTITCRASQSILTYLN WYQQKPGKAPKLLIYAATSRASGVPSRFSGSGSG TDFTLTISSLQPEDFATYYCQQSYDTPLTFGGGT KVEIK (SEQ ID NO: 4392) |
| 376_E09 | EVQLLESGGGLVQPGGSLRLSCAASGFT FDSYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4224) | DIQMTQSPSSLSASVGDRVTITCRASQSILTYLN WYQQKPGKAPKLLIYAATSRHSGVPSRFSGSGSG TDFTLTISSLQPEDFATYYCQQSYDTPLTFGGGT KVEIK (SEQ ID NO: 4393) |
| 365_H04 | EVQLLESGGGLVQPGGSLRLSCAASGFT FSDYGMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4225) | DIQMTQSPSSLSASVGDRVTITCRASQSILTYVN WYQQKPGKAPKLVIYAATSRASGVPSRFSGSGSG TDFTLTISSLQPEDFATYYCQQSYESPLTFGGGT KVEIK (SEQ ID NO: 4394) |
| 369_E04 | EVQLLESGGGLVQPGGSLRLSCAASGFT FSDYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4226) | DIQMTQSPSSLSASVGDRVTITCRASQSILSYVN WYQQKPGKAPKLVIYAATSRASGVPSRFSGSGSG TDFTLTISSLQPEDFATYYCQQSYSLPLTFGGGT KVEIK (SEQ ID NO: 4395) |
| 374_B11 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4227) | DIQMTQSPSSLSASVGDRVTITCRASQSILTYVN WYQQKPGKAPKLVIYAATSRASGVPSRFSGSGSG TDFTLTISSLQPEDFATYYCQQSYDLPLTFGGGT KVEIK (SEQ ID NO: 4396) |
| 376_G11 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4228) | DIQMTQSPSSLSASVGDRVTITCRASQSIVTYVN WYQQKPGKAPKLVIYAATSLASGVPSRFSGSGSG TDFTLTISSLQPEDFATYYCQQSYNLPLTFGGGT KVEIK (SEQ ID NO: 4397) |
| 374_E04 | EVQLLESGGGLVQPGGSLRLSCAASGFT FSSYSMNWVRQAPGKGLEWVSGINYNSG YKSYADSVKGRFTISRDNSKNTLYLQMN SLRAEDTAVYYCARSATWHDTHLDYWGQ GTLVTVSS (SEQ ID NO: 4229) | DIQMTQSPSSLSASVGDRVTITCRASQSILSYLN WYQQKPGKAPKLLIYAVTSRASGVPSRFSGSGSG TDFTLTISSLQPEDFATYYCQQSYNNPLTFGGGT KVEIK (SEQ ID NO: 4398) |
| 373_E08 | EVQLLESGGGLVQPGGSLRLSCAASGFT FDSYGMNWVRQAPGKGLEWVSGINYNSG YTSYADSVKGRFTISRDNSKNTLYLQMN SLRAEDTAVYYCARSATWHDTHLDYWGQ GTLVTVSS (SEQ ID NO: 4230) | DIQMTQSPSSLSASVGDRVTITCRASQSIVSYVN WYQQKPGKAPKLLIYAVTSRASGVPSRFSGSGSG TDFTLTISSLQPEDFATYYCQQSYESPLTFGGGT KVEIK (SEQ ID NO: 4399) |
| 375_B10 | EVQLLESGGGLVQPGGSLRLSCAASGFT FDSYSMNWVRQAPGKGLEWVSGINYNSG YTSYADSVKGRFTISRDNSKNTLYLQMN SLRAEDTAVYYCARSATWHDTHLDYWGQ GTLVTVSS (SEQ ID NO: 4231) | DIQMTQSPSSLSASVGDRVTITCRASQSILSYLN WYQQKPGKAPKLLIYAATSRHSGVPSRFSGSGSG TDFTLTISSLQPEDFATYYCQQSYDLPLTFGGGT KVEIK (SEQ ID NO: 4400) |

TABLE 2F-continued

| Group IV Antibody Sequences | | |
|---|---|---|
| Ab | VH sequence | VL sequence |
| 365_E08 | EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSATWHDTHLDYWGQGTLVTVSS (SEQ ID NO: 4232) | DIQMTQSPSSLSASVGDRVTITCRASQSIISYVNWYQQKPGKAPKLVIYAATSLASGVPSRFSGSGSGTDFTLTISSLQPEDFATYYCQQSYDLPLTFGGGTKVEIK (SEQ ID NO: 4401) |
| 374_G02 | EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSATWHDTHLDYWGQGTLVTVSS (SEQ ID NO: 4233) | DIQMTQSPSSLSASVGDRVTITCRASQSILTYLNWYQQKPGKAPKLLIYAASSLQSGVPSRFSGSGSGTDFTLTISSLQPEDFATYYCQQSYDTPLTFGGGTKVEIK (SEQ ID NO: 4402) |
| 373_D09 | EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSATWHDTHLDYWGQGTLVTVSS (SEQ ID NO: 4234) | DIQMTQSPSSLSASVGDRVTITCRASQSILTYLNWYQQKPGKAPKLVIYAATSRHSGVPSRFSGSGSGTDFTLTISSLQPEDFATYYCQQSYENPLTFGGGTKVEIK (SEQ ID NO: 4403) |
| 365_A04 | EVQLLESGGGLVQPGGSLRLSCAASGFTFSDYSMNWVRQAPGKGLEWVSGINYNSGYTSYADSVKGRFTISRDNSKNTLYLQMNSLRAEDTAVYYCARSATWHDTHLDYWGQGTLVTVSS (SEQ ID NO: 4235) | DIQMTQSPSSLSASVGDRVTITCRASQSIVSYVNWYQQKPGKAPKLVIYAATSLASGVPSRFSGSGSGTDFTLTISSLQPEDFATYYCQQSYSTPLTFGGGTKVEIK (SEQ ID NO: 4404) |
| 371_B05 | EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARSATWHDTHLDYWGQGTLVTVSS (SEQ ID NO: 4236) | DIQMTQSPSSLSASVGDRVTITCRASQSILTYLNWYQQKPGKAPKLVIYAATSLASGVPSRFSGSGSGTDFTLTISSLQPEDFATYYCQQSDETPLTFGGGTKVEIK (SEQ ID NO: 4405) |
| 376_H08 | EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARSATWHDTHLDYWGQGTLVTVSS (SEQ ID NO: 4237) | DIQMTQSPSSLSASVGDRVTITCRASQSILTYLNWYQQKPGKAPKLLIYAATSRHSGVPSRFSGSGSGTDFTLTISSLQPEDFATYYCQQSDSLPLTFGGGTKVEIK (SEQ ID NO: 4406) |
| 367_G08 | EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARSATWHDTHLDYWGQGTLVTVSS (SEQ ID NO: 4238) | DIQMTQSPSSLSASVGDRVTITCRASQSILSYLNWYQQKPGKAPKLLIYAATSRASGVPSRFSGSGSGTDFTLTISSLQPEDFATYYCQQSYENPLTFGGGTKVEIK (SEQ ID NO: 4407) |
| 372_H03 | EVQLLESGGGLVQPGGSLRLSCAASGFTFDSYGMNWVRQAPGKGLEWVSNINYNGGYKSYADSVKGRFTISRDNSKNTLYLQMNSLRAEDTAVYYCARSATWHDTHLDYWGQGTLVTVSS (SEQ ID NO: 4239) | DIQMTQSPSSLSASVGDRVTITCRASQSIITYVNWYQQKPGKAPKLLIYAATSLASGVPSRFSGSGSGTDFTLTISSLQPEDFATYYCQQSYNLPLTFGGGTKVEIK (SEQ ID NO: 4408) |
| 366_E03 | EVQLLESGGGLVQPGGSLRLSCAASGFTFDSYGMNWVRQAPGKGLEWVSNINYNGGYKSYADSVKGRFTISRDNSKNTLYLQMNSLRAEDTAVYYCARSATWHDTHLDYWGQGTLVTVSS (SEQ ID NO: 4240) | DIQMTQSPSSLSASVGDRVTITCRASQSILTYLNWYQQKPGKAPKLVIYAATSRHSGVPSRFSGSGSGTDFTLTISSLQPEDFATYYCQQSYSNPLTFGGGTKVEIK (SEQ ID NO: 4409) |
| 371_F12 | EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARSATWHDTHLDYWGQGTLVTVSS (SEQ ID NO: 4241) | DIQMTQSPSSLSASVGDRVTITCRASQSIISYLNWYQQKPGKAPKLLIYAATSRASGVPSRFSGSGSGTDFTLTISSLQPEDFATYYCQQSNNLPLTFGGGTKVEIK (SEQ ID NO: 4410) |
| 366_C03 | EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4242) | DIQMTQSPSSLSASVGDRVTITCRASQSILSYLNWYQQKPGKAPKLVIYAATSRASGVPSRFSGSGSGTDFTLTISSLQPEDFATYYCQQSYSNPLTFGGGTKVEIK (SEQ ID NO: 4411) |
| 376_A01 | EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4243) | DIQMTQSPSSLSASVGDRVTITCRASQSIVSYLNWYQQKPGKAPKLLIYAATSRASGVPSRFSGSGSGTDFTLTISSLQPEDFATYYCQQSYSTPLTFGGGTKVEIK (SEQ ID NO: 4412) |

TABLE 2F-continued

Group IV Antibody Sequences

| Ab | VH sequence | VL sequence |
|---|---|---|
| 365_E03 | EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4244) | DIQMTQSPSSLSASVGDRVTITCRASQSILTYVNWYQQKPGKAPKLLIYAATSLHSGVPSRFSGSGSGTDFTLTISSLQPEDFATYYCQQSDERPLTFGGGTKVEIK (SEQ ID NO: 4413) |
| 371_B10 | EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4245) | DIQMTQSPSSLSASVGDRVTITCRASQSIVSYVNWYQQKPGKAPKLLIYAATSRASGVPSRFSGSGSGTDFTLTISSLQPEDFATYYCQQSYDLPLTFGGGTKVEIK (SEQ ID NO: 4414) |
| 369_G09 | EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4246) | DIQMTQSPSSLSASVGDRVTITCRASQSIVTYLNWYQQKPGKAPKLLIYAATSRASGVPSRFSGSGSGTDFTLTISSLQPEDFATYYCQQSYDLPLTFGGGTKVEIK (SEQ ID NO: 4415) |
| 369_A06 | EVQLLESGGGLVQPGGSLRLSCAASGFTFSDYGMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4247) | DIQMTQSPSSLSASVGDRVTITCRASQSILSYVNWYQQKPGKAPKLLIYAATSLASGVPSRFSGSGSGTDFTLTISSLQPEDFATYYCQQSYDLPLTFGGGTKVEIK (SEQ ID NO: 4416) |
| 369_C08 | EVQLLESGGGLVQPGGSLRLSCAASGFTFSDYGMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4248) | DIQMTQSPSSLSASVGDRVTITCRASQSILTYLNWYQQKPGKAPKLVIYAATSLASGVPSRFSGSGSGTDFTLTISSLQPEDFATYYCQQSYENPLTFGGGTKVEIK (SEQ ID NO: 4417) |
| 373_A07 | EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARSATWHDTHLDYWGQGTLVTVSS (SEQ ID NO: 4249) | DIQMTQSPSSLSASVGDRVTITCRASQSILTYVNWYQQKPGKAPKLLIYAATSRASGVPSRFSGSGSGTDFTLTISSLQPEDFATYYCQQSDNLPLTFGGGTKVEIK (SEQ ID NO: 4418) |
| 367_D02 | EVQLLESGGGLVQPGGSLRLSCAASGFTFDDYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4250) | DIQMTQSPSSLSASVGDRVTITCRASQSIVTYVNWYQQKPGKAPKLLIYAATSRASGVPSRFSGSGSGTDFTLTISSLQPEDFATYYCQQSYENPLTFGGGTKVEIK (SEQ ID NO: 4419) |
| 374_C07 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4251) | DIQMTQSPSSLSASVGDRVTITCRASQSIISYLNWYQQKPGKAPKLLIYAATSRASGVPSRFSGSGSGTDFTLTISSLQPEDFATYYCQQSDELPLTFGGGTKVEIK (SEQ ID NO: 4420) |
| 374_A03 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4252) | DIQMTQSPSSLSASVGDRVTITCRASQSILTYLNWYQQKPGKAPKLLIYAATSRASGVPSRFSGSGSGTDFTLTISSLQPEDFATYYCQQSYDNPLTFGGGTKVEIK (SEQ ID NO: 4421) |
| 365_A02 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4253) | DIQMTQSPSSLSASVGDRVTITCRASQSILTYVNWYQQKPGKAPKLLIYAATSRASGVPSRFSGSGSGTDFTLTISSLQPEDFATYYCQQSYNSPLTFGGGTKVEIK (SEQ ID NO: 4422) |
| 365_D06 | EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4254) | DIQMTQSPSSLSASVGDRVTITCRASQSILTYVNWYQQKPGKAPKLLIYAATSRASGVPSRFSGSGSGTDFTLTISSLQPEDFATYYCQQSYSLPLTFGGGTKVEIK (SEQ ID NO: 4423) |
| 366_C07 | EVQLLESGGGLVQPGGSLRLSCAASGFTFSSYSMNWVRQAPGKGLEWVSNINYNGGYTSYADSVKGRFTISRDNSKNTLYLQMNSLRAEDTAVYYCARSATWHDTHLDYWGQGTLVTVSS (SEQ ID NO: 4255) | DIQMTQSPSSLSASVGDRVTITCRASQSILTYVNWYQQKPGKAPKLLIYAATSRASGVPSRFSGSGSGTDFTLTISSLQPEDFATYYCQQSYNSPLTFGGGTKVEIK (SEQ ID NO: 4424) |

TABLE 2F-continued

Group IV Antibody Sequences

| Ab | VH sequence | VL sequence |
|---|---|---|
| 367_F12 | EVQLLESGGGLVQPGGSLRLSCAASGFT FDDYSMNWVRQAPGKGLEWVSNINYNSG YKGYADSVKGRFTISRDNSKNTLYLQMN SLRAEDTAVYYCARSATWHDTHLDYWGQ GTLVTVSS (SEQ ID NO: 4256) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 4425) |
| 369_E09 | EVQLLESGGGLVQPGGSLRLSCAASGFT FDSYSMNWVRQAPGKGLEWVSNINYNSG YKGYADSVKGRFTISRDNSKNTLYLQMN SLRAEDTAVYYCARSATWHDTHLDYWGQ GTLVTVSS (SEQ ID NO: 4257) | DIQMTQSPSSLSASVGDRVTITCRASQSILSYLN WYQQKPGKAPKLVIYAATSRASGVPSRFSGSGSG TDFTLTISSLQPEDFATYYCQQSYDLPLTFGGGT KVEIK (SEQ ID NO: 4426) |
| 365_G02 | EVQLLESGGGLVQPGGSLRLSCAASGFT FSDYSMNWVRQAPGKGLEWVSNINYNSG YKGYADSVKGRFTISRDNSKNTLYLQMN SLRAEDTAVYYCARSATWHDTHLDYWGQ GTLVTVSS (SEQ ID NO: 4258) | DIQMTQSPSSLSASVGDRVTITCRASQSIVTYLN WYQQKPGKAPKLVIYAVTSLHSGVPSRFSGSGSG TDFTLTISSLQPEDFATYYCQQSYELPLTFGGGT KVEIK (SEQ ID NO: 4427) |
| 373_D02 | EVQLLESGGGLVQPGGSLRLSCAASGFT FSSYSMNWVRQAPGKGLEWVSNINYNSG YKGYADSVKGRFTISRDNSKNTLYLQMN SLRAEDTAVYYCARSATWHDTHLDYWGQ GTLVTVSS (SEQ ID NO: 4259) | DIQMTQSPSSLSASVGDRVTITCRASQSILSYLN WYQQKPGKAPKLLIYAATSLASGVPSRFSGSGSG TDFTLTISSLQPEDFATYYCQQSYDLPLTFGGGT KVEIK (SEQ ID NO: 4428) |
| 374_E03 | EVQLLESGGGLVQPGGSLRLSCAASGFT FSSYSMNWVRQAPGKGLEWVSNINYNSG YKGYADSVKGRFTISRDNSKNTLYLQMN SLRAEDTAVYYCARSATWHDTHLDYWGQ GTLVTVSS (SEQ ID NO: 4260) | DIQMTQSPSSLSASVGDRVTITCRASQSILTYVN WYQQKPGKAPKLVIYAATSLASGVPSRFSGSGSG TDFTLTISSLQPEDFATYYCQQSYDTPLTFGGGT KVEIK (SEQ ID NO: 4429) |
| 374_D11 | EVQLLESGGGLVQPGGSLRLSCAASGFT FDSYGMNWVRQAPGKGLEWVSNINYNSG YTGYADSVKGRFTISRDNSKNTLYLQMN SLRAEDTAVYYCARSATWHDTHLDYWGQ GTLVTVSS (SEQ ID NO: 4261) | DIQMTQSPSSLSASVGDRVTITCRASQSILTYLN WYQQKPGKAPKLLIYAATSRASGVPSRFSGSGSG TDFTLTISSLQPEDFATYYCQQSYETPLTFGGGT KVEIK (SEQ ID NO: 4430) |
| 370_D07 | EVQLLESGGGLVQPGGSLRLSCAASGFT FSSYGMNWVRQAPGKGLEWVSNINYNSG YTGYADSVKGRFTISRDNSKNTLYLQMN SLRAEDTAVYYCARSATWHDTHLDYWGQ GTLVTVSS (SEQ ID NO: 4262) | DIQMTQSPSSLSASVGDRVTITCRASQSILSYVN WYQQKPGKAPKLVIYAATSLASGVPSRFSGSGSG TDFTLTISSLQPEDFATYYCQQSYESPLTFGGGT KVEIK (SEQ ID NO: 4431) |
| 374_A08 | EVQLLESGGGLVQPGGSLRLSCAASGFT FDSYSMNWVRQAPGKGLEWVSNINYNSG YTSYADSVKGRFTISRDNSKNTLYLQMN SLRAEDTAVYYCARSATWHDTHLDYWGQ GTLVTVSS (SEQ ID NO: 4263) | DIQMTQSPSSLSASVGDRVTITCRASQSIVTYLN WYQQKPGKAPKLLIYAATSLASGVPSRFSGSGSG TDFTLTISSLQPEDFATYYCQQSYDLPLTFGGGT KVEIK (SEQ ID NO: 4432) |
| 374_G01 | EVQLLESGGGLVQPGGSLRLSCAASGFT FDSYSMNWVRQAPGKGLEWVSNINYNSG YTSYADSVKGRFTISRDNSKNTLYLQMN SLRAEDTAVYYCARSATWHDTHLDYWGQ GTLVTVSS (SEQ ID NO: 4264) | DIQMTQSPSSLSASVGDRVTITCRASQSILTYVN WYQQKPGKAPKLLIYATTSRHSGVPSRFSGSGSG TDFTLTISSLQPEDFATYYCQQSYNLPLTFGGGT KVEIK (SEQ ID NO: 4433) |
| 374_G12 | EVQLLESGGGLVQPGGSLRLSCAASGFT FDDYGMNWVRQAPGKGLEWVSSINYNGG YKSYADSVKGRFTISRDNSKNTLYLQMN SLRAEDTAVYYCARSATWHDTHLDYWGQ GTLVTVSS (SEQ ID NO: 4265) | DIQMTQSPSSLSASVGDRVTITCRASQSILTYVN WYQQKPGKAPKLVIYAATSLASGVPSRFSGSGSG TDFTLTISSLQPEDFATYYCQQSYNSPLTFGGGT KVEIK (SEQ ID NO: 4434) |
| 375_G10 | EVQLLESGGGLVQPGGSLRLSCAASGFT FSSYGMNWVRQAPGKGLEWVSSINYNGG YKSYADSVKGRFTISRDNSKNTLYLQMN SLRAEDTAVYYCARSATWHDTHLDYWGQ GTLVTVSS (SEQ ID NO: 4266) | DIQMTQSPSSLSASVGDRVTITCRASQSIVTYLN WYQQKPGKAPKLVIYAATSRHSGVPSRFSGSGSG TDFTLTISSLQPEDFATYYCQQSYDTPLTFGGGT KVEIK (SEQ ID NO: 4435) |
| 369_H11 | EVQLLESGGGLVQPGGSLRLSCAASGFT FSDYGMNWVRQAPGKGLEWVSSINYNGG YTGYADSVKGRFTISRDNSKNTLYLQMN SLRAEDTAVYYCARSATWHDTHLDYWGQ GTLVTVSS (SEQ ID NO: 4267) | DIQMTQSPSSLSASVGDRVTITCRASQSILSYLN WYQQKPGKAPKLLIYAATSRHSGVPSRFSGSGSG TDFTLTISSLQPEDFATYYCQQSYDLPLTFGGGT KVEIK (SEQ ID NO: 4436) |

TABLE 2F-continued

Group IV Antibody Sequences

| Ab | VH sequence | VL sequence |
|---|---|---|
| 375_G12 | EVQLLESGGGLVQPGGSLRLSCAASGFT FDSYGMHWVRQAPGKGLEWVSSINYNGG YTSYADSVKGRFTISRDNSKNTLYLQMN SLRAEDTAVYYCARSATWHDTHLDYWGQ GTLVTVSS (SEQ ID NO: 4268) | DIQMTQSPSSLSASVGDRVTITCRASQSIVSYVN WYQQKPGKAPKLLIYAATSRHSGVPSRFSGSGSG TDFTLTISSLQPEDFATYYCQQSYDTPLTFGGGT KVEIK (SEQ ID NO: 4437) |
| 366_F06 | EVQLLESGGGLVQPGGSLRLSCAASGFT FSDYGMNWVRQAPGKGLEWVSSINYNGG YTSYADSVKGRFTISRDNSKNTLYLQMN SLRAEDTAVYYCARSATWHDTHLDYWGQ GTLVTVSS (SEQ ID NO: 4269) | DIQMTQSPSSLSASVGDRVTITCRASQSISTYLN WYQQKPGKAPKLLIYAATSLASGVPSRFSGSGSG TDFTLTISSLQPEDFATYYCQQSYSNPLTFGGGT KVEIK (SEQ ID NO: 4438) |
| 368_G07 | EVQLLESGGGLVQPGGSLRLSCAASGFT FSSYSMHWVRQAPGKGLEWVSSINYNGG YTSYADSVKGRFTISRDNSKNTLYLQMN SLRAEDTAVYYCARSATWHDTHLDYWGQ GTLVTVSS (SEQ ID NO: 4270) | DIQMTQSPSSLSASVGDRVTITCRASQSIVSYVN WYQQKPGKAPKLVIYAATSRASGVPSRFSGSGSG TDFTLTISSLQPEDFATYYCQQSYDTPLTFGGGT KVEIK (SEQ ID NO: 4439) |
| 367_H04 | EVQLLESGGGLVQPGGSLRLSCAASGFT FSSYSMNWVRQAPGKGLEWVSSINYNGG YTSYADSVKGRFTISRDNSKNTLYLQMN SLRAEDTAVYYCARSATWHDTHLDYWGQ GTLVTVSS (SEQ ID NO: 4271) | DIQMTQSPSSLSASVGDRVTITCRASQSILTYVN WYQQKPGKAPKLLIYAATSRHSGVPSRFSGSGSG TDFTLTISSLQPEDFATYYCQQSDNNPLTFGGGT KVEIK (SEQ ID NO: 4440) |
| 374_E06 | EVQLLESGGGLVQPGGSLRLSCAASGFT FDSYSMNWVRQAPGKGLEWVSSINYNSG YKGYADSVKGRFTISRDNSKNTLYLQMN SLRAEDTAVYYCARSATWHDTHLDYWGQ GTLVTVSS (SEQ ID NO: 4272) | DIQMTQSPSSLSASVGDRVTITCRASQSILSYLN WYQQKPGKAPKLLIYAATSRASGVPSRFSGSGSG TDFTLTISSLQPEDFATYYCQQSYDLPLTFGGGT KVEIK (SEQ ID NO: 4441) |
| 370_A10 | EVQLLESGGGLVQPGGSLRLSCAASGFT FSDYSMNWVRQAPGKGLEWVSSINYNSG YKGYADSVKGRFTISRDNSKNTLYLQMN SLRAEDTAVYYCARSATWHDTHLDYWGQ GTLVTVSS (SEQ ID NO: 4273) | DIQMTQSPSSLSASVGDRVTITCRASQSILSYVN WYQQKPGKAPKLLIYAATSLASGVPSRFSGSGSG TDFTLTISSLQPEDFATYYCQQSYDTPLTFGGGT KVEIK (SEQ ID NO: 4442) |
| 368_H10 | EVQLLESGGGLVQPGGSLRLSCAASGFT FSSYSMNWVRQAPGKGLEWVSSINYNSG YKGYADSVKGRFTISRDNSKNTLYLQMN SLRAEDTAVYYCARSATWHDTHLDYWGQ GTLVTVSS (SEQ ID NO: 4274) | DIQMTQSPSSLSASVGDRVTITCRASQSIVSYVN WYQQKPGKAPKLVIYAVTSLASGVPSRFSGSGSG TDFTLTISSLQPEDFATYYCQQSYETPLTFGGGT KVEIK (SEQ ID NO: 4443) |
| 368_G08 | EVQLLESGGGLVQPGGSLRLSCAASGFT FDDYGMNWVRQAPGKGLEWVSSINYNSG YKSYADSVKGRFTISRDNSKNTLYLQMN SLRAEDTAVYYCARSATWHDTHLDYWGQ GTLVTVSS (SEQ ID NO: 4275) | DIQMTQSPSSLSASVGDRVTITCRASQSIVSYVN WYQQKPGKAPKLLIYAATSRHSGVPSRFSGSGSG TDFTLTISSLQPEDFATYYCQQSYNNPLTFGGGT KVEIK (SEQ ID NO: 4444) |
| 365_H09 | EVQLLESGGGLVQPGGSLRLSCAASGFT FSSYGMNWVRQAPGKGLEWVSSINYNSG YKSYADSVKGRFTISRDNSKNTLYLQMN SLRAEDTAVYYCARSATWHDTHLDYWGQ GTLVTVSS (SEQ ID NO: 4276) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 4445) |
| 370_A08 | EVQLLESGGGLVQPGGSLRLSCAASGFT FDSYSMNWVRQAPGKGLEWVSSINYNSG YTGYADSVKGRFTISRDNSKNTLYLQMN SLRAEDTAVYYCARSATWHDTHLDYWGQ GTLVTVSS (SEQ ID NO: 4277) | DIQMTQSPSSLSASVGDRVTITCRASQSIVTYLN WYQQKPGKAPKLLIYAATSRASGVPSRFSGSGSG TDFTLTISSLQPEDFATYYCQQSYDLPLTFGGGT KVEIK (SEQ ID NO: 4446) |
| 368_B05 | EVQLLESGGGLVQPGGSLRLSCAASGFT FDSYSMNWVRQAPGKGLEWVSSINYNSG YTGYADSVKGRFTISRDNSKNTLYLQMN SLRAEDTAVYYCARSATWHDTHLDYWGQ GTLVTVSS (SEQ ID NO: 4278) | DIQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 4447) |
| 375_F01 | EVQLLESGGGLVQPGGSLRLSCAASGFT FSSYSMNWVRQAPGKGLEWVSSINYNSG YTGYADSVKGRFTISRDNSKNTLYLQMN SLRAEDTAVYYCARSATWHDTHLDYWGQ GTLVTVSS (SEQ ID NO: 4279) | DIQMTQSPSSLSASVGDRVTITCRASQSIVSYLN WYQQKPGKAPKLVIYAATSRASGVPSRFSGSGSG TDFTLTISSLQPEDFATYYCQQSYDNPLTFGGGT KVEIK (SEQ ID NO: 4448) |

TABLE 2F-continued

Group IV Antibody Sequences

| Ab | VH sequence | VL sequence |
|---|---|---|
| 374_F09 | EVQLLESGGGLVQPGGSLRLSCAASGFT FSSYGMNWVRQAPGKGLEWVSSINYNSG YTSYADSVKGRFTISRDNSKNTLYLQMN SLRAEDTAVYYCARSATWHDTHLDYWGQ GTLVTVSS (SEQ ID NO: 4280) | DIQMTQSPSSLSASVGDRVTITCRASQSISSYVN WYQQKPGKAPKLLIYAATSRASGVPSRFSGSGSG TDFTLTISSLQPEDFATYYCQQSYSTPLTFGGGT KVEIK (SEQ ID NO: 4449) |

Table 3F provides the amino acid sequences of the CDRs of the antibodies shown in Table 2F.

TABLE 3F

CDR sequences for Group VI antibodies

| Ab | HCDR1 | HCDR2 | HCDR3 | LCDR1 | LCDR2 | LCDR3 |
|---|---|---|---|---|---|---|
| 365_E02 | SSYSMN (SEQ ID NO: 4450) | WVANINYNGGYTS (SEQ ID NO: 4619) | AKSATWHDTHLD (SEQ ID NO: 4788) | ISYLNWY (SEQ ID NO: 4957) | LLIYAATSRA (SEQ ID NO: 5126) | QQSYENPL (SEQ ID NO: 5295) |
| 370_G12 | SSYSMN (SEQ ID NO: 4451) | WVAGINYNGGYKG (SEQ ID NO: 4620) | ARSATWHDTALD (SEQ ID NO: 4789) | ITYLNWY (SEQ ID NO: 4958) | LLIYAATSLA (SEQ ID NO: 5127) | QQSDESPL (SEQ ID NO: 5296) |
| 368_C01 | DSYGMN (SEQ ID NO: 4452) | WVAGINYNGGYTG (SEQ ID NO: 4621) | ARSATWHDTALD (SEQ ID NO: 4790) | ITYLNWY (SEQ ID NO: 4959) | LLIYAATSRA (SEQ ID NO: 5128) | QQSYDSPL (SEQ ID NO: 5297) |
| 376_C06 | SSYGMN (SEQ ID NO: 4453) | WVAGINYNGGYTS (SEQ ID NO: 4622) | ARSATWHDTALD (SEQ ID NO: 4791) | LSYLNWY (SEQ ID NO: 4960) | LVIYAATSRA (SEQ ID NO: 5129) | QQSYDSPL (SEQ ID NO: 5298) |
| 368_D10 | DSYGMN (SEQ ID NO: 4454) | WVAGINYNSGYTS (SEQ ID NO: 4623) | ARSATWHDTALD (SEQ ID NO: 4792) | LSYLNWY (SEQ ID NO: 4961) | LVIYAATSRA (SEQ ID NO: 5130) | QQSYDSPL (SEQ ID NO: 5299) |
| 365_G12 | SSYGMN (SEQ ID NO: 4455) | WVAGINYNSGYTS (SEQ ID NO: 4624) | ARSATWHDTALD (SEQ ID NO: 4793) | LSYVNWY (SEQ ID NO: 4962) | LVIYAATSRA (SEQ ID NO: 5131) | QQSYSNPL (SEQ ID NO: 5300) |
| 367_C03 | SSYSMN (SEQ ID NO: 4456) | WVANINYNGGYTG (SEQ ID NO: 4625) | ARSATWHDTALD (SEQ ID NO: 4794) | LSYVNWY (SEQ ID NO: 4963) | LVIYATTSRA (SEQ ID NO: 5132) | QQSYENPL (SEQ ID NO: 5301) |
| 367_H07 | SSYSMN (SEQ ID NO: 4457) | WVANINYNGGYTG (SEQ ID NO: 4626) | ARSATWHDTALD (SEQ ID NO: 4795) | LSYVNWY (SEQ ID NO: 4964) | LVIYATTSRA (SEQ ID NO: 5133) | QQSYENPL (SEQ ID NO: 5302) |
| 371_D03 | DSYGMN (SEQ ID NO: 4458) | WVANINYNGGYTS (SEQ ID NO: 4627) | ARSATWHDTALD (SEQ ID NO: 4796) | LTYVNWY (SEQ ID NO: 4965) | LVIYAATSLA (SEQ ID NO: 5134) | QQSYNTPL (SEQ ID NO: 5303) |
| 369_C10 | SSYSMN (SEQ ID NO: 4459) | WVANINYNGGYTS (SEQ ID NO: 4628) | ARSATWHDTALD (SEQ ID NO: 4797) | VTYLNWY (SEQ ID NO: 4966) | LLIYAATSLH (SEQ ID NO: 5135) | QQSDSLPL (SEQ ID NO: 5304) |
| 367_F05 | SSYGMN (SEQ ID NO: 4460) | WVASINYNGGYTG (SEQ ID NO: 4629) | ARSATWHDTALD (SEQ ID NO: 4798) | LSYVNWY (SEQ ID NO: 4967) | LLIYAATSRA (SEQ ID NO: 5136) | QQSYSSPL (SEQ ID NO: 5305) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 365_C07 | SDYGMN (SEQ ID NO: 4461) | WVASINYNGGYTS (SEQ ID NO: 4630) | ARSATWHDTALD (SEQ ID NO: 4799) | VSYVNWY (SEQ ID NO: 4968) | LLIYAATSRA (SEQ ID NO: 5137) | QQSYDTPL (SEQ ID NO: 5306) |
| 374_C08 | DSYGMN (SEQ ID NO: 4462) | WVSGINYNSGYKS (SEQ ID NO: 4631) | ARSATWHDTALD (SEQ ID NO: 4800) | LSYVNWY (SEQ ID NO: 4969) | LLIYAVTSRA (SEQ ID NO: 5138) | QQSYDSPL (SEQ ID NO: 5307) |
| 376_A06 | DSYSMN (SEQ ID NO: 4463) | WVSGINYNSGYTS (SEQ ID NO: 4632) | ARSATWHDTALD (SEQ ID NO: 4801) | LSYLNWY (SEQ ID NO: 4970) | LVIYYVSNRA (SEQ ID NO: 5139) | QQSYDNPL (SEQ ID NO: 5308) |
| 376_B07 | DSYSMN (SEQ ID NO: 4464) | WVSGINYNSGYTS (SEQ ID NO: 4633) | ARSATWHDTALD (SEQ ID NO: 4802) | LSYLNWY (SEQ ID NO: 4971) | LVIYYVSNRA (SEQ ID NO: 5140) | QQSYDNPL (SEQ ID NO: 5309) |
| 365_F07 | SSYSMN (SEQ ID NO: 4465) | WVSNINYNGGYKS (SEQ ID NO: 4634) | ARSATWHDTALD (SEQ ID NO: 4803) | LSYVNWY (SEQ ID NO: 4972) | LVIYAATSRA (SEQ ID NO: 5141) | QQSYDLPL (SEQ ID NO: 5310) |
| 369_E10 | SSYSMN (SEQ ID NO: 4466) | WVSNINYNGGYKS (SEQ ID NO: 4635) | ARSATWHDTALD (SEQ ID NO: 4804) | LSYVNWY (SEQ ID NO: 4973) | LVIYAATSRA (SEQ ID NO: 5142) | QQSYDLPL (SEQ ID NO: 5311) |
| 373_E03 | DSYGMN (SEQ ID NO: 4467) | WVSNINYNGGYTG (SEQ ID NO: 4636) | ARSATWHDTALD (SEQ ID NO: 4805) | LSYVNWY (SEQ ID NO: 4974) | LVIYAATSRA (SEQ ID NO: 5143) | QQSYDLPL (SEQ ID NO: 5312) |
| 366_B04 | DSYSMN (SEQ ID NO: 4468) | WVAGINYNGGYKG (SEQ ID NO: 4637) | ARSATWHDTHLD (SEQ ID NO: 4806) | LTYVNWY (SEQ ID NO: 4975) | LVIYAATSRH (SEQ ID NO: 5144) | QQSYDTPL (SEQ ID NO: 5313) |
| 376_F12 | DDYSMN (SEQ ID NO: 4469) | WVAGINYNGGYKS (SEQ ID NO: 4638) | ARSATWHDTHLD (SEQ ID NO: 4807) | ISYVNWY (SEQ ID NO: 4976) | LLIYAASSLQ (SEQ ID NO: 5145) | QQSYSTPL (SEQ ID NO: 5314) |
| 369_F07 | DSYSMN (SEQ ID NO: 4470) | WVAGINYNGGYKS (SEQ ID NO: 4639) | ARSATWHDTHLD (SEQ ID NO: 4808) | LSYVNWY (SEQ ID NO: 4977) | LVIYAATSRA (SEQ ID NO: 5146) | QQSYESPL (SEQ ID NO: 5315) |
| 368_C06 | DSYSMN (SEQ ID NO: 4471) | WVAGINYNGGYKS (SEQ ID NO: 4640) | ARSATWHDTHLD (SEQ ID NO: 4809) | SSYLNWY (SEQ ID NO: 4978) | LLIYAASSLQ (SEQ ID NO: 5147) | QQSYSTPL (SEQ ID NO: 5316) |
| 376_E12 | SSYSMN (SEQ ID NO: 4472) | WVAGINYNGGYKS (SEQ ID NO: 4641) | ARSATWHDTHLD (SEQ ID NO: 4810) | LSYLNWY (SEQ ID NO: 4979) | LLIYAASSLQ (SEQ ID NO: 5148) | QQSYSTPL (SEQ ID NO: 5317) |
| 371_H01 | DSYSMN (SEQ ID NO: 4473) | WVAGINYNGGYTG (SEQ ID NO: 4642) | ARSATWHDTHLD (SEQ ID NO: 4811) | ITYLNWY (SEQ ID NO: 4980) | LLIYAASSLQ (SEQ ID NO: 5149) | QQSYSTPL (SEQ ID NO: 5318) |
| 367_E02 | DSYSMN (SEQ ID NO: 4474) | WVAGINYNGGYTG (SEQ ID NO: 4643) | ARSATWHDTHLD (SEQ ID NO: 4812) | SSYLNWY (SEQ ID NO: 4981) | LLIYAASSLQ (SEQ ID NO: 5150) | QQSYSTPL (SEQ ID NO: 5319) |
| 365_F04 | SSYGMN (SEQ ID NO: 4475) | WVAGINYNGGYTG (SEQ ID NO: 4644) | ARSATWHDTHLD (SEQ ID NO: 4813) | VTYVNWY (SEQ ID NO: 4982) | LLIYAATSRA (SEQ ID NO: 5151) | QQSYDTPL (SEQ ID NO: 5320) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 370_A09 | SSYSMN (SEQ ID NO: 4476) | WVAGINYNGGYTG (SEQ ID NO: 4645) | ARSATWHDTHLD (SEQ ID NO: 4814) | LTYLNWY (SEQ ID NO: 4983) | LVIYAATSRA (SEQ ID NO: 5152) | QQSYDTPL (SEQ ID NO: 5321) |
| 365_B03 | SSYSMN (SEQ ID NO: 4477) | WVAGINYNGGYTG (SEQ ID NO: 4646) | ARSATWHDTHLD (SEQ ID NO: 4815) | VSYLNWY (SEQ ID NO: 4984) | LLIYAATSRA (SEQ ID NO: 5153) | QQSYENPL (SEQ ID NO: 5322) |
| 369_A05 | SSYSMN (SEQ ID NO: 4478) | WVAGINYNGGYTG (SEQ ID NO: 4647) | ARSATWHDTHLD (SEQ ID NO: 4816) | LTYVNWY (SEQ ID NO: 4985) | LVIYAATSRA (SEQ ID NO: 5154) | QQSYESPL (SEQ ID NO: 5323) |
| 373_H10 | SSYSMN (SEQ ID NO: 4479) | WVAGINYNGGYTG (SEQ ID NO: 4648) | ARSATWHDTHLD (SEQ ID NO: 4817) | LSYVNWY (SEQ ID NO: 4986) | LLIYAATSRA (SEQ ID NO: 5155) | QQSYSLPL (SEQ ID NO: 5324) |
| 367_A09 | DSYGMN (SEQ ID NO: 4480) | WVAGINYNGGYTS (SEQ ID NO: 4649) | ARSATWHDTHLD (SEQ ID NO: 4818) | LSYVNWY (SEQ ID NO: 4987) | LVIYAATSRH (SEQ ID NO: 5156) | QQSYDTPL (SEQ ID NO: 5325) |
| 370_F08 | DSYSMN (SEQ ID NO: 4481) | WVAGINYNGGYTS (SEQ ID NO: 4650) | ARSATWHDTHLD (SEQ ID NO: 4819) | ISYVNWY (SEQ ID NO: 4988) | LLIYAATSRH (SEQ ID NO: 5157) | QQSYNLPL (SEQ ID NO: 5326) |
| 376_B01 | DSYSMN (SEQ ID NO: 4482) | WVAGINYNGGYTS (SEQ ID NO: 4651) | ARSATWHDTHLD (SEQ ID NO: 4820) | LTYVNWY (SEQ ID NO: 4989) | LVIYAATSRA (SEQ ID NO: 5158) | QQSYNLPL (SEQ ID NO: 5327) |
| 365_D05 | DSYSMN (SEQ ID NO: 4483) | WVAGINYNGGYTS (SEQ ID NO: 4652) | ARSATWHDTHLD (SEQ ID NO: 4821) | LTYVNWY (SEQ ID NO: 4990) | LLIYAATSRA (SEQ ID NO: 5159) | QQSYNSPL (SEQ ID NO: 5328) |
| 373_E04 | DSYSMN (SEQ ID NO: 4484) | WVAGINYNGGYTS (SEQ ID NO: 4653) | ARSATWHDTHLD (SEQ ID NO: 4822) | LTYVNWY (SEQ ID NO: 4991) | LLIYAATSRA (SEQ ID NO: 5160) | QQSYNSPL (SEQ ID NO: 5329) |
| 368_G05 | DSYSMN (SEQ ID NO: 4485) | WVAGINYNGGYTS (SEQ ID NO: 4654) | ARSATWHDTHLD (SEQ ID NO: 4823) | LTYVNWY (SEQ ID NO: 4992) | LLIYAATSLH (SEQ ID NO: 5161) | QQSYNTPL (SEQ ID NO: 5330) |
| 365_A01 | SDYGMN (SEQ ID NO: 4486) | WVAGINYNGGYTS (SEQ ID NO: 4655) | ARSATWHDTHLD (SEQ ID NO: 4824) | LTYVNWY (SEQ ID NO: 4993) | LVIYATTSLA (SEQ ID NO: 5162) | QQSYSTPL (SEQ ID NO: 5331) |
| 373_H06 | SSYGMH (SEQ ID NO: 4487) | WVAGINYNGGYTS (SEQ ID NO: 4656) | ARSATWHDTHLD (SEQ ID NO: 4825) | ISYVNWY (SEQ ID NO: 4994) | LLIYAATSLA (SEQ ID NO: 5163) | QQSYDLPL (SEQ ID NO: 5332) |
| 369_G07 | SSYSMN (SEQ ID NO: 4488) | WVAGINYNGGYTS (SEQ ID NO: 4657) | ARSATWHDTHLD (SEQ ID NO: 4826) | LTYVNWY (SEQ ID NO: 4995) | LVIYAATSRA (SEQ ID NO: 5164) | QQSYDNPL (SEQ ID NO: 5333) |
| 373_G05 | SSYSMN (SEQ ID NO: 4489) | WVAGINYNGGYTS (SEQ ID NO: 4658) | ARSATWHDTHLD (SEQ ID NO: 4827) | LSYLNWY (SEQ ID NO: 4996) | LLIYAATSLA (SEQ ID NO: 5165) | QQSYELPL (SEQ ID NO: 5334) |
| 372_F07 | DDYSMN (SEQ ID NO: 4490) | WVAGINYNSGYKG (SEQ ID NO: 4659) | ARSATWHDTHLD (SEQ ID NO: 4828) | LTYLNWY (SEQ ID NO: 4997) | LVIYAATSRA (SEQ ID NO: 5166) | QQSYELPL (SEQ ID NO: 5335) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 370_H03 | DSYSMN (SEQ ID NO: 4491) | WVAGINYNSGYKG (SEQ ID NO: 4660) | ARSATWHDTHLD (SEQ ID NO: 4829) | LTYLNWY (SEQ ID NO: 4998) | LLIYAATSLA (SEQ ID NO: 5167) | QQSYDTPL (SEQ ID NO: 5336) |
| 366_A03 | DSYSMN (SEQ ID NO: 4492) | WVAGINYNSGYKG (SEQ ID NO: 4661) | ARSATWHDTHLD (SEQ ID NO: 4830) | SSYLNWY (SEQ ID NO: 4999) | LLIYAATSLA (SEQ ID NO: 5168) | QQSYSNPL (SEQ ID NO: 5337) |
| 365_A07 | SSYGMN (SEQ ID NO: 4493) | WVAGINYNSGYKG (SEQ ID NO: 4662) | ARSATWHDTHLD (SEQ ID NO: 4831) | VSYLNWY (SEQ ID NO: 5000) | LLIYAATSRA (SEQ ID NO: 5169) | QQSYNLPL (SEQ ID NO: 5338) |
| 376_B06 | SSYSMN (SEQ ID NO: 4494) | WVAGINYNSGYKG (SEQ ID NO: 4663) | ARSATWHDTHLD (SEQ ID NO: 4832) | LTYLNWY (SEQ ID NO: 5001) | LLIYAATSRA (SEQ ID NO: 5170) | QQSYDLPL (SEQ ID NO: 5339) |
| 374_C11 | SSYSMN (SEQ ID NO: 4495) | WVAGINYNSGYKG (SEQ ID NO: 4664) | ARSATWHDTHLD (SEQ ID NO: 4833) | LTYLNWY (SEQ ID NO: 5002) | LLIYAATSRA (SEQ ID NO: 5171) | QQSYESPL (SEQ ID NO: 5340) |
| 375_A06 | SSYSMN (SEQ ID NO: 4496) | WVAGINYNSGYKG (SEQ ID NO: 4665) | ARSATWHDTHLD (SEQ ID NO: 4834) | LTYVNWY (SEQ ID NO: 5003) | LLIYAASSLQ (SEQ ID NO: 5172) | QQSYSTPL (SEQ ID NO: 5341) |
| 365_B09 | DSYSMN (SEQ ID NO: 4497) | WVAGINYNSGYKS (SEQ ID NO: 4666) | ARSATWHDTHLD (SEQ ID NO: 4835) | LRYLNWY (SEQ ID NO: 5004) | LLIYAATSLH (SEQ ID NO: 5173) | QQSYDNPL (SEQ ID NO: 5342) |
| 373_E06 | DSYSMN (SEQ ID NO: 4498) | WVAGINYNSGYKS (SEQ ID NO: 4667) | ARSATWHDTHLD (SEQ ID NO: 4836) | LRYLNWY (SEQ ID NO: 5005) | LLIYAATSLH (SEQ ID NO: 5174) | QQSYDNPL (SEQ ID NO: 5343) |
| 374_C05 | DSYSMN (SEQ ID NO: 4499) | WVAGINYNSGYKS (SEQ ID NO: 4668) | ARSATWHDTHLD (SEQ ID NO: 4837) | IRYLNWY (SEQ ID NO: 5006) | LVIYAATSRA (SEQ ID NO: 5175) | QQSYDNPL (SEQ ID NO: 5344) |
| 376_C11 | DSYSMN (SEQ ID NO: 4500) | WVAGINYNSGYKS (SEQ ID NO: 4669) | ARSATWHDTHLD (SEQ ID NO: 4838) | LTYLNWY (SEQ ID NO: 5007) | LVIYAATSRA (SEQ ID NO: 5176) | QQSYDNPL (SEQ ID NO: 5345) |
| 373_C09 | DSYSMN (SEQ ID NO: 4501) | WVAGINYNSGYKS (SEQ ID NO: 4670) | ARSATWHDTHLD (SEQ ID NO: 4839) | LTYLNWY (SEQ ID NO: 5008) | LVIYAATSRA (SEQ ID NO: 5177) | QQSYELPL (SEQ ID NO: 5346) |
| 368_H01 | SSYSMN (SEQ ID NO: 4502) | WVAGINYNSGYKS (SEQ ID NO: 4671) | ARSATWHDTHLD (SEQ ID NO: 4840) | LSYLNWY (SEQ ID NO: 5009) | LLIYATTSLA (SEQ ID NO: 5178) | QQSYDNPL (SEQ ID NO: 5347) |
| 373_B03 | SSYSMN (SEQ ID NO: 4503) | WVAGINYNSGYKS (SEQ ID NO: 4672) | ARSATWHDTHLD (SEQ ID NO: 4841) | LTYLNWY (SEQ ID NO: 5010) | LVIYAATSLA (SEQ ID NO: 5179) | QQSYDNPL (SEQ ID NO: 5348) |
| 374_C04 | SSYSMN (SEQ ID NO: 4504) | WVAGINYNSGYKS (SEQ ID NO: 4673) | ARSATWHDTHLD (SEQ ID NO: 4842) | LTYLNWY (SEQ ID NO: 5011) | LLIYAASSLQ (SEQ ID NO: 5180) | QQSYELPL (SEQ ID NO: 5349) |
| 371_F05 | SSYSMN (SEQ ID NO: 4505) | WVAGINYNSGYKS (SEQ ID NO: 4674) | ARSATWHDTHLD (SEQ ID NO: 4843) | LSYLNWY (SEQ ID NO: 5012) | LLIYAATSRH (SEQ ID NO: 5181) | QQSYENPL (SEQ ID NO: 5350) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 369_A10 | DSYSMN (SEQ ID NO: 4506) | WVAGINYNSGYTG (SEQ ID NO: 4675) | ARSATWHDTHLD (SEQ ID NO: 4844) | LSYLNWY (SEQ ID NO: 5013) | LLIYAATSRA (SEQ ID NO: 5182) | QQSYELPL (SEQ ID NO: 5351) |
| 366_A05 | SSYSMN (SEQ ID NO: 4507) | WVAGINYNSGYTG (SEQ ID NO: 4676) | ARSATWHDTHLD (SEQ ID NO: 4845) | LTYVNWY (SEQ ID NO: 5014) | LVIYAATSLA (SEQ ID NO: 5183) | QQSYNTPL (SEQ ID NO: 5352) |
| 375_G07 | DSYSMN (SEQ ID NO: 4508) | WVAGINYNSGYTS (SEQ ID NO: 4677) | ARSATWHDTHLD (SEQ ID NO: 4846) | LSYLNWY (SEQ ID NO: 5015) | LVIYAATSLA (SEQ ID NO: 5184) | QQSYDLPL (SEQ ID NO: 5353) |
| 374_D02 | DSYSMN (SEQ ID NO: 4509) | WVAGINYNSGYTS (SEQ ID NO: 4678) | ARSATWHDTHLD (SEQ ID NO: 4847) | STYVNWY (SEQ ID NO: 5016) | LLIYAVTSLA (SEQ ID NO: 5185) | QQSYDSPL (SEQ ID NO: 5354) |
| 365_A10 | SSYGMH (SEQ ID NO: 4510) | WVAGINYNSGYTS (SEQ ID NO: 4679) | ARSATWHDTHLD (SEQ ID NO: 4848) | LTYLNWY (SEQ ID NO: 5017) | LVIYAVTSLA (SEQ ID NO: 5186) | QQSYDSPL (SEQ ID NO: 5355) |
| 375_A02 | SSYSMN (SEQ ID NO: 4511) | WVAGINYNSGYTS (SEQ ID NO: 4680) | ARSATWHDTHLD (SEQ ID NO: 4849) | SSYLNWY (SEQ ID NO: 5018) | LLIYAASSLQ (SEQ ID NO: 5187) | QQSYSTPL (SEQ ID NO: 5356) |
| 371_G03 | SSYGMN (SEQ ID NO: 4512) | WVANINYNGGYKG (SEQ ID NO: 4681) | ARSATWHDTHLD (SEQ ID NO: 4850) | VTYVNWY (SEQ ID NO: 5019) | LVIYAATSLA (SEQ ID NO: 5188) | QQSYNLPL (SEQ ID NO: 5357) |
| 370_E07 | DSYSMN (SEQ ID NO: 4513) | WVANINYNGGYTG (SEQ ID NO: 4682) | ARSATWHDTHLD (SEQ ID NO: 4851) | LTYLNWY (SEQ ID NO: 5020) | LLIYAATSRA (SEQ ID NO: 5189) | QQSYDNPL (SEQ ID NO: 5358) |
| 375_B04 | DSYSMN (SEQ ID NO: 4514) | WVANINYNGGYTG (SEQ ID NO: 4683) | ARSATWHDTHLD (SEQ ID NO: 4852) | LTYLNWY (SEQ ID NO: 5021) | LLIYAATSRA (SEQ ID NO: 5190) | QQSYDNPL (SEQ ID NO: 5359) |
| 367_G07 | DSYSMN (SEQ ID NO: 4515) | WVANINYNGGYTG (SEQ ID NO: 4684) | ARSATWHDTHLD (SEQ ID NO: 4853) | LTYVNWY (SEQ ID NO: 5022) | LLIYAATSRA (SEQ ID NO: 5191) | QQSYDNPL (SEQ ID NO: 5360) |
| 366_C02 | SDYSMN (SEQ ID NO: 4516) | WVANINYNGGYTG (SEQ ID NO: 4685) | ARSATWHDTHLD (SEQ ID NO: 4854) | VSYLNWY (SEQ ID NO: 5023) | LLIYAATSRA (SEQ ID NO: 5192) | QQSYDNPL (SEQ ID NO: 5361) |
| 375_C12 | SSYSMN (SEQ ID NO: 4517) | WVANINYNGGYTG (SEQ ID NO: 4686) | ARSATWHDTHLD (SEQ ID NO: 4855) | LTYLNWY (SEQ ID NO: 5024) | LLIYAATSRA (SEQ ID NO: 5193) | QQSYDLPL (SEQ ID NO: 5362) |
| 365_F08 | DDYGMN (SEQ ID NO: 4518) | WVANINYNGGYTS (SEQ ID NO: 4687) | ARSATWHDTHLD (SEQ ID NO: 4856) | LSYVNWY (SEQ ID NO: 5025) | LLIYAATSRH (SEQ ID NO: 5194) | QQSYSLPL (SEQ ID NO: 5363) |
| 368_G09 | DSYGMH (SEQ ID NO: 4519) | WVANINYNGGYTS (SEQ ID NO: 4688) | ARSATWHDTHLD (SEQ ID NO: 4857) | VSYLNWY (SEQ ID NO: 5026) | LVIYAATSRA (SEQ ID NO: 5195) | QQSYDTPL (SEQ ID NO: 5364) |
| 368_E11 | DSYGMH (SEQ ID NO: 4520) | WVANINYNGGYTS (SEQ ID NO: 4689) | ARSATWHDTHLD (SEQ ID NO: 4858) | ISYVNWY (SEQ ID NO: 5027) | LLIYAATSRH (SEQ ID NO: 5196) | QQSYELPL (SEQ ID NO: 5365) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 367_F02 | DSYSMN (SEQ ID NO: 4521) | WVANINYNGGYTS (SEQ ID NO: 4690) | ARSATWHDTHLD (SEQ ID NO: 4859) | ISYVNWY (SEQ ID NO: 5028) | LLIYAATSRH (SEQ ID NO: 5197) | QQSYESPL (SEQ ID NO: 5366) |
| 373_B08 | DSYSMN (SEQ ID NO: 4522) | WVANINYNSGYKG (SEQ ID NO: 4691) | ARSATWHDTHLD (SEQ ID NO: 4860) | LTYLNWY (SEQ ID NO: 5029) | LVIYAATSLA (SEQ ID NO: 5198) | QQSYENPL (SEQ ID NO: 5367) |
| 374_A11 | SDYSMN (SEQ ID NO: 4523) | WVANINYNSGYKG (SEQ ID NO: 4692) | ARSATWHDTHLD (SEQ ID NO: 4861) | LSYVNWY (SEQ ID NO: 5030) | LVIYAATSRA (SEQ ID NO: 5199) | QQSYSSPL (SEQ ID NO: 5368) |
| 373_B11 | SSYSMN (SEQ ID NO: 4524) | WVANINYNSGYKG (SEQ ID NO: 4693) | ARSATWHDTHLD (SEQ ID NO: 4862) | LSYLNWY (SEQ ID NO: 5031) | LLIYAATSRA (SEQ ID NO: 5200) | QQSYDNPL (SEQ ID NO: 5369) |
| 373_F03 | DSYSMN (SEQ ID NO: 4525) | WVANINYNSGYTG (SEQ ID NO: 4694) | ARSATWHDTHLD (SEQ ID NO: 4863) | LTYVNWY (SEQ ID NO: 5032) | LLIYAATSRH (SEQ ID NO: 5201) | QQSYDSPL (SEQ ID NO: 5370) |
| 372_D04 | SSYSMN (SEQ ID NO: 4526) | WVANINYNSGYTG (SEQ ID NO: 4695) | ARSATWHDTHLD (SEQ ID NO: 4864) | LTYLNWY (SEQ ID NO: 5033) | LLIYAATSLH (SEQ ID NO: 5202) | QQSYDLPL (SEQ ID NO: 5371) |
| 366_C01 | SDYGMN (SEQ ID NO: 4527) | WVASINYNGGYTG (SEQ ID NO: 4696) | ARSATWHDTHLD (SEQ ID NO: 4865) | VTYLNWY (SEQ ID NO: 5034) | LLIYAATSPA (SEQ ID NO: 5203) | QQSYELPL (SEQ ID NO: 5372) |
| 367_A01 | SSYSMN (SEQ ID NO: 4528) | WVASINYNGGYTG (SEQ ID NO: 4697) | ARSATWHDTHLD (SEQ ID NO: 4866) | LTYLNWY (SEQ ID NO: 5035) | LLIYAATSRA (SEQ ID NO: 5204) | QQSYDLPL (SEQ ID NO: 5373) |
| 366_H05 | DSYGMH (SEQ ID NO: 4529) | WVASINYNGGYTS (SEQ ID NO: 4698) | ARSATWHDTHLD (SEQ ID NO: 4867) | LSYVNWY (SEQ ID NO: 5036) | LLIYAATSLA (SEQ ID NO: 5205) | QQSYDLPL (SEQ ID NO: 5374) |
| 369_B09 | DSYGMH (SEQ ID NO: 4530) | WVASINYNGGYTS (SEQ ID NO: 4699) | ARSATWHDTHLD (SEQ ID NO: 4868) | LTYLNWY (SEQ ID NO: 5037) | LLIYAATSRA (SEQ ID NO: 5206) | QQSYENPL (SEQ ID NO: 5375) |
| 366_D07 | SDYGMH (SEQ ID NO: 4531) | WVASINYNGGYTS (SEQ ID NO: 4700) | ARSATWHDTHLD (SEQ ID NO: 4869) | LTYLNWY (SEQ ID NO: 5038) | LLIYAATSLA (SEQ ID NO: 5207) | QQSYSSPL (SEQ ID NO: 5376) |
| 369_D11 | SSYGMH (SEQ ID NO: 4532) | WVASINYNGGYTS (SEQ ID NO: 4701) | ARSATWHDTHLD (SEQ ID NO: 4870) | LTYLNWY (SEQ ID NO: 5039) | LVIYAATSLA (SEQ ID NO: 5208) | QQSDELPL (SEQ ID NO: 5377) |
| 370_B05 | SSYGMN (SEQ ID NO: 4533) | WVASINYNGGYTS (SEQ ID NO: 4702) | ARSATWHDTHLD (SEQ ID NO: 4871) | LTYVNWY (SEQ ID NO: 5040) | LVIYAATSRA (SEQ ID NO: 5209) | QQSYENPL (SEQ ID NO: 5378) |
| 366_D02 | SSYSMN (SEQ ID NO: 4534) | WVASINYNGGYTS (SEQ ID NO: 4703) | ARSATWHDTHLD (SEQ ID NO: 4872) | LSYVNWY (SEQ ID NO: 5041) | LLIYATTSLA (SEQ ID NO: 5210) | QQSYDLPL (SEQ ID NO: 5379) |
| 368_H12 | DSYSMN (SEQ ID NO: 4535) | WVASINYNSGYKG (SEQ ID NO: 4704) | ARSATWHDTHLD (SEQ ID NO: 4873) | VTYLNWY (SEQ ID NO: 5042) | LLIYAATSRA (SEQ ID NO: 5211) | QQSYESPL (SEQ ID NO: 5380) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 368_F12 | DDYSMN (SEQ ID NO: 4536) | WVASINYNSGYKS (SEQ ID NO: 4705) | ARSATWHDTHLD (SEQ ID NO: 4874) | VTYLNWY (SEQ ID NO: 5043) | LVIYAATSLA (SEQ ID NO: 5212) | QQSYDLPL (SEQ ID NO: 5381) |
| 370_A06 | SSYSMN (SEQ ID NO: 4537) | WVASINYNSGYKS (SEQ ID NO: 4706) | ARSATWHDTHLD (SEQ ID NO: 4875) | VTYLNWY (SEQ ID NO: 5044) | LVIYAATSLA (SEQ ID NO: 5213) | QQSYDLPL (SEQ ID NO: 5382) |
| 369_F12 | SSYSMN (SEQ ID NO: 4538) | WVASINYNSGYKS (SEQ ID NO: 4707) | ARSATWHDTHLD (SEQ ID NO: 4876) | ISYLNWY (SEQ ID NO: 5045) | LLIYAVTSLA (SEQ ID NO: 5214) | QQSYENPL (SEQ ID NO: 5383) |
| 366_A09 | SDYGMH (SEQ ID NO: 4539) | WVASINYNSGYTS (SEQ ID NO: 4708) | ARSATWHDTHLD (SEQ ID NO: 4877) | LTYLNWY (SEQ ID NO: 5046) | LLIYAATSRH (SEQ ID NO: 5215) | QQSYETPL (SEQ ID NO: 5384) |
| 368_H07 | SSYGMH (SEQ ID NO: 4540) | WVASINYNSGYTS (SEQ ID NO: 4709) | ARSATWHDTHLD (SEQ ID NO: 4878) | LSYLNWY (SEQ ID NO: 5047) | LLIYAATSRA (SEQ ID NO: 5216) | QQSYENPL (SEQ ID NO: 5385) |
| 370_C04 | SSYGMN (SEQ ID NO: 4541) | WVASINYNSGYTS (SEQ ID NO: 4710) | ARSATWHDTHLD (SEQ ID NO: 4879) | LSYLNWY (SEQ ID NO: 5048) | LLIYAASSLQ (SEQ ID NO: 5217) | QQSYENPL (SEQ ID NO: 5386) |
| 373_E02 | DSYGMH (SEQ ID NO: 4542) | WVSGINYNGGYKG (SEQ ID NO: 4711) | ARSATWHDTHLD (SEQ ID NO: 4880) | VRYLNWY (SEQ ID NO: 5049) | LLIYAASSLQ (SEQ ID NO: 5218) | QQSYSTPL (SEQ ID NO: 5387) |
| 374_E09 | SDYSMN (SEQ ID NO: 4543) | WVSGINYNGGYKG (SEQ ID NO: 4712) | ARSATWHDTHLD (SEQ ID NO: 4881) | VTYLNWY (SEQ ID NO: 5050) | LVIYAATSRA (SEQ ID NO: 5219) | QQSYDSPL (SEQ ID NO: 5388) |
| 371_C09 | DSYSMN (SEQ ID NO: 4544) | WVSGINYNGGYKS (SEQ ID NO: 4713) | ARSATWHDTHLD (SEQ ID NO: 4882) | LTYVNWY (SEQ ID NO: 5051) | LLIYAASSLQ (SEQ ID NO: 5220) | QQSYDNPL (SEQ ID NO: 5389) |
| 369_B12 | DSYSMN (SEQ ID NO: 4545) | WVSGINYNGGYKS (SEQ ID NO: 4714) | ARSATWHDTHLD (SEQ ID NO: 4883) | LTYVNWY (SEQ ID NO: 5052) | LLIYATTSLA (SEQ ID NO: 5221) | QQSYDSPL (SEQ ID NO: 5390) |
| 369_B02 | DSYSMN (SEQ ID NO: 4546) | WVSGINYNGGYKS (SEQ ID NO: 4715) | ARSATWHDTHLD (SEQ ID NO: 4884) | LSYLNWY (SEQ ID NO: 5053) | LVIYAATSRA (SEQ ID NO: 5222) | QQSYNLPL (SEQ ID NO: 5391) |
| 365_C09 | SDYGMN (SEQ ID NO: 4547) | WVSGINYNGGYKS (SEQ ID NO: 4716) | ARSATWHDTHLD (SEQ ID NO: 4885) | VSYVNWY (SEQ ID NO: 5054) | LLIYAATSRA (SEQ ID NO: 5223) | QQSYDTPL (SEQ ID NO: 5392) |
| 374_B09 | SSYSMN (SEQ ID NO: 4548) | WVSGINYNGGYKS (SEQ ID NO: 4717) | ARSATWHDTHLD (SEQ ID NO: 4886) | VRYLNWY (SEQ ID NO: 5055) | LVIYAATSLA (SEQ ID NO: 5224) | QQSYELPL (SEQ ID NO: 5393) |
| 374_D12 | DSYSMN (SEQ ID NO: 4549) | WVSGINYNGGYTG (SEQ ID NO: 4718) | ARSATWHDTHLD (SEQ ID NO: 4887) | VSYVNWY (SEQ ID NO: 5056) | LVIYAATSRA (SEQ ID NO: 5225) | QQSYDLPL (SEQ ID NO: 5394) |
| 374_C02 | DSYSMN (SEQ ID NO: 4550) | WVSGINYNGGYTG (SEQ ID NO: 4719) | ARSATWHDTHLD (SEQ ID NO: 4888) | LSYLNWY (SEQ ID NO: 5057) | LLIYAATSRH (SEQ ID NO: 5226) | QQSYDSPL (SEQ ID NO: 5395) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 374_H08 | DSYSMN (SEQ ID NO: 4551) | WVSGINYNGGYTG (SEQ ID NO: 4720) | ARSATWHDTHLD (SEQ ID NO: 4889) | LSYLNWY (SEQ ID NO: 5058) | LLIYAATSLH (SEQ ID NO: 5227) | QQSYENPL (SEQ ID NO: 5396) |
| 369_D06 | DSYSMN (SEQ ID NO: 4552) | WVSGINYNGGYTG (SEQ ID NO: 4721) | ARSATWHDTHLD (SEQ ID NO: 4890) | LTYLNWY (SEQ ID NO: 5059) | LLIYAATSRA (SEQ ID NO: 5228) | QQSYETPL (SEQ ID NO: 5397) |
| 366_B06 | DSYSMN (SEQ ID NO: 4553) | WVSGINYNGGYTS (SEQ ID NO: 4722) | ARSATWHDTHLD (SEQ ID NO: 4891) | LTYVNWY (SEQ ID NO: 5060) | LVIYAAPSLA (SEQ ID NO: 5229) | QQSYXTPL (SEQ ID NO: 5398) |
| 367_A11 | SSYGMH (SEQ ID NO: 4554) | WVSGINYNGGYTS (SEQ ID NO: 4723) | ARSATWHDTHLD (SEQ ID NO: 4892) | LSYVNWY (SEQ ID NO: 5061) | LVIYATTSLA (SEQ ID NO: 5230) | QQSYNSPL (SEQ ID NO: 5399) |
| 369_F04 | SSYGMN (SEQ ID NO: 4555) | WVSGINYNGGYTS (SEQ ID NO: 4724) | ARSATWHDTHLD (SEQ ID NO: 4893) | ISYVNWY (SEQ ID NO: 5062) | LLIYAATSRH (SEQ ID NO: 5231) | QQSYDNPL (SEQ ID NO: 5400) |
| 369_A01 | DSYSMN (SEQ ID NO: 4556) | WVSGINYNSGYKG (SEQ ID NO: 4725) | ARSATWHDTHLD (SEQ ID NO: 4894) | LTYVNWY (SEQ ID NO: 5063) | LVIYAATSLA (SEQ ID NO: 5232) | QQSYELPL (SEQ ID NO: 5401) |
| 373_H12 | SDYSMN (SEQ ID NO: 4557) | WVSGINYNSGYKG (SEQ ID NO: 4726) | ARSATWHDTHLD (SEQ ID NO: 4895) | LTYLNWY (SEQ ID NO: 5064) | LLIYAATSRA (SEQ ID NO: 5233) | QQSYNSPL (SEQ ID NO: 5402) |
| 376_C07 | SSYSMN (SEQ ID NO: 4558) | WVSGINYNSGYKG (SEQ ID NO: 4727) | ARSATWHDTHLD (SEQ ID NO: 4896) | LSYVNWY (SEQ ID NO: 5065) | LLIYAATSRH (SEQ ID NO: 5234) | QQSYDLPL (SEQ ID NO: 5403) |
| 366_E02 | SSYSMN (SEQ ID NO: 4559) | WVSGINYNSGYKG (SEQ ID NO: 4728) | ARSATWHDTHLD (SEQ ID NO: 4897) | SSYLNWY (SEQ ID NO: 5066) | LLIYAASSLQ (SEQ ID NO: 5235) | QQSYNSPL (SEQ ID NO: 5404) |
| 376_G01 | DDYSMN (SEQ ID NO: 4560) | WVSGINYNSGYKS (SEQ ID NO: 4729) | ARSATWHDTHLD (SEQ ID NO: 4898) | LSYVNWY (SEQ ID NO: 5067) | LVIYAVTSRA (SEQ ID NO: 5236) | QQSYELPL (SEQ ID NO: 5405) |
| 373_F02 | DSYSMN (SEQ ID NO: 4561) | WVSGINYNSGYKS (SEQ ID NO: 4730) | ARSATWHDTHLD (SEQ ID NO: 4899) | LTYLNWY (SEQ ID NO: 5068) | LLIYAATSRA (SEQ ID NO: 5237) | QQSYDTPL (SEQ ID NO: 5406) |
| 376_E09 | DSYSMN (SEQ ID NO: 4562) | WVSGINYNSGYKS (SEQ ID NO: 4731) | ARSATWHDTHLD (SEQ ID NO: 4900) | LTYLNWY (SEQ ID NO: 5069) | LLIYAATSRH (SEQ ID NO: 5238) | QQSYDTPL (SEQ ID NO: 5407) |
| 365_H04 | SDYGMN (SEQ ID NO: 4563) | WVSGINYNSGYKS (SEQ ID NO: 4732) | ARSATWHDTHLD (SEQ ID NO: 4901) | LTYVNWY (SEQ ID NO: 5070) | LVIYAATSRA (SEQ ID NO: 5239) | QQSYESPL (SEQ ID NO: 5408) |
| 369_E04 | SDYSMN (SEQ ID NO: 4564) | WVSGINYNSGYKS (SEQ ID NO: 4733) | ARSATWHDTHLD (SEQ ID NO: 4902) | LSYVNWY (SEQ ID NO: 5071) | LVIYAATSRA (SEQ ID NO: 5240) | QQSYSLPL (SEQ ID NO: 5409) |
| 374_B11 | SSYSMN (SEQ ID NO: 4565) | WVSGINYNSGYKS (SEQ ID NO: 4734) | ARSATWHDTHLD (SEQ ID NO: 4903) | LTYVNWY (SEQ ID NO: 5072) | LVIYAATSRA (SEQ ID NO: 5241) | QQSYDLPL (SEQ ID NO: 5410) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 376_G11 | SSYSMN (SEQ ID NO: 4566) | WVSGINYNSGYKS (SEQ ID NO: 4735) | ARSATWHDTHLD (SEQ ID NO: 4904) | VTYVNWY (SEQ ID NO: 5073) | LVIYAATSLA (SEQ ID NO: 5242) | QQSYNLPL (SEQ ID NO: 5411) |
| 374_E04 | SSYSMN (SEQ ID NO: 4567) | WVSGINYNSGYKS (SEQ ID NO: 4736) | ARSATWHDTHLD (SEQ ID NO: 4905) | LSYLNWY (SEQ ID NO: 5074) | LLIYAVTSRA (SEQ ID NO: 5243) | QQSYNNPL (SEQ ID NO: 5412) |
| 373_E08 | DSYGMN (SEQ ID NO: 4568) | WVSGINYNSGYTS (SEQ ID NO: 4737) | ARSATWHDTHLD (SEQ ID NO: 4906) | VSYVNWY (SEQ ID NO: 5075) | LLIYAVTSRA (SEQ ID NO: 5244) | QQSYESPL (SEQ ID NO: 5413) |
| 375_B10 | DSYSMN (SEQ ID NO: 4569) | WVSGINYNSGYTS (SEQ ID NO: 4738) | ARSATWHDTHLD (SEQ ID NO: 4907) | LSYLNWY (SEQ ID NO: 5076) | LLIYAATSRH (SEQ ID NO: 5245) | QQSYDLPL (SEQ ID NO: 5414) |
| 365_E08 | DSYSMN (SEQ ID NO: 4570) | WVSGINYNSGYTS (SEQ ID NO: 4739) | ARSATWHDTHLD (SEQ ID NO: 4908) | ISYVNWY (SEQ ID NO: 5077) | LVIYAATSLA (SEQ ID NO: 5246) | QQSYDLPL (SEQ ID NO: 5415) |
| 374_G02 | DSYSMN (SEQ ID NO: 4571) | WVSGINYNSGYTS (SEQ ID NO: 4740) | ARSATWHDTHLD (SEQ ID NO: 4909) | LTYLNWY (SEQ ID NO: 5078) | LLIYAASSLQ (SEQ ID NO: 5247) | QQSYDTPL (SEQ ID NO: 5416) |
| 373_D09 | DSYSMN (SEQ ID NO: 4572) | WVSGINYNSGYTS (SEQ ID NO: 4741) | ARSATWHDTHLD (SEQ ID NO: 4910) | LTYLNWY (SEQ ID NO: 5079) | LVIYAATSRH (SEQ ID NO: 5248) | QQSYENPL (SEQ ID NO: 5417) |
| 365_A04 | SDYSMN (SEQ ID NO: 4573) | WVSGINYNSGYTS (SEQ ID NO: 4742) | ARSATWHDTHLD (SEQ ID NO: 4911) | VSYVNWY (SEQ ID NO: 5080) | LVIYAATSLA (SEQ ID NO: 5249) | QQSYSTPL (SEQ ID NO: 5418) |
| 371_B05 | SSYSMN (SEQ ID NO: 4574) | WVSGINYNSGYTS (SEQ ID NO: 4743) | ARSATWHDTHLD (SEQ ID NO: 4912) | LTYLNWY (SEQ ID NO: 5081) | LVIYAATSLA (SEQ ID NO: 5250) | QQSDETPL (SEQ ID NO: 5419) |
| 376_H08 | DSYGMN (SEQ ID NO: 4575) | WVSNINYNGGYKG (SEQ ID NO: 4744) | ARSATWHDTHLD (SEQ ID NO: 4913) | LTYLNWY (SEQ ID NO: 5082) | LLIYAATSRH (SEQ ID NO: 5251) | QQSDSLPL (SEQ ID NO: 5420) |
| 367_G08 | DSYGMN (SEQ ID NO: 4576) | WVSNINYNGGYKG (SEQ ID NO: 4745) | ARSATWHDTHLD (SEQ ID NO: 4914) | LSYLNWY (SEQ ID NO: 5083) | LLIYAATSRA (SEQ ID NO: 5252) | QQSYENPL (SEQ ID NO: 5421) |
| 372_H03 | DSYGMN (SEQ ID NO: 4577) | WVSNINYNGGYKS (SEQ ID NO: 4746) | ARSATWHDTHLD (SEQ ID NO: 4915) | ITYVNWY (SEQ ID NO: 5084) | LLIYAATSLA (SEQ ID NO: 5253) | QQSYNLPL (SEQ ID NO: 5422) |
| 366_E03 | DSYGMN (SEQ ID NO: 4578) | WVSNINYNGGYKS (SEQ ID NO: 4747) | ARSATWHDTHLD (SEQ ID NO: 4916) | LTYLNWY (SEQ ID NO: 5085) | LVIYAATSRH (SEQ ID NO: 5254) | QQSYSNPL (SEQ ID NO: 5423) |
| 371_F12 | DSYSMN (SEQ ID NO: 4579) | WVSNINYNGGYKS (SEQ ID NO: 4748) | ARSATWHDTHLD (SEQ ID NO: 4917) | ISYLNWY (SEQ ID NO: 5086) | LLIYAATSRA (SEQ ID NO: 5255) | QQSNNLPL (SEQ ID NO: 5424) |
| 366_C03 | DSYGMN (SEQ ID NO: 4580) | WVSNINYNGGYTG (SEQ ID NO: 4749) | ARSATWHDTHLD (SEQ ID NO: 4918) | LSYLNWY (SEQ ID NO: 5087) | LVIYAATSRA (SEQ ID NO: 5256) | QQSYSNPL (SEQ ID NO: 5425) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 376_A01 | DSYGMN (SEQ ID NO: 4581) | WVSNINYNGGYTG (SEQ ID NO: 4750) | ARSATWHDTHLD (SEQ ID NO: 4919) | VSYLNWY (SEQ ID NO: 5088) | LLIYAATSRA (SEQ ID NO: 5257) | QQSYSTPL (SEQ ID NO: 5426) |
| 365_E03 | DSYSMN (SEQ ID NO: 4582) | WVSNINYNGGYTG (SEQ ID NO: 4751) | ARSATWHDTHLD (SEQ ID NO: 4920) | LTYVNWY (SEQ ID NO: 5089) | LLIYAATSLH (SEQ ID NO: 5258) | QQSDERPL (SEQ ID NO: 5427) |
| 371_B10 | DSYSMN (SEQ ID NO: 4583) | WVSNINYNGGYTG (SEQ ID NO: 4752) | ARSATWHDTHLD (SEQ ID NO: 4921) | VSYVNWY (SEQ ID NO: 5090) | LLIYAATSRA (SEQ ID NO: 5259) | QQSYDLPL (SEQ ID NO: 5428) |
| 369_G09 | DSYSMN (SEQ ID NO: 4584) | WVSNINYNGGYTG (SEQ ID NO: 4753) | ARSATWHDTHLD (SEQ ID NO: 4922) | VTYLNWY (SEQ ID NO: 5091) | LLIYAATSRA (SEQ ID NO: 5260) | QQSYDLPL (SEQ ID NO: 5429) |
| 369_A06 | SDYGMN (SEQ ID NO: 4585) | WVSNINYNGGYTG (SEQ ID NO: 4754) | ARSATWHDTHLD (SEQ ID NO: 4923) | LSYVNWY (SEQ ID NO: 5092) | LLIYAATSLA (SEQ ID NO: 5261) | QQSYDLPL (SEQ ID NO: 5430) |
| 369_C08 | SDYGMN (SEQ ID NO: 4586) | WVSNINYNGGYTG (SEQ ID NO: 4755) | ARSATWHDTHLD (SEQ ID NO: 4924) | LTYLNWY (SEQ ID NO: 5093) | LVIYAATSLA (SEQ ID NO: 5262) | QQSYENPL (SEQ ID NO: 5431) |
| 373_A07 | SSYSMN (SEQ ID NO: 4587) | WVSNINYNGGYTG (SEQ ID NO: 4756) | ARSATWHDTHLD (SEQ ID NO: 4925) | LTYVNWY (SEQ ID NO: 5094) | LLIYAATSRA (SEQ ID NO: 5263) | QQSDNLPL (SEQ ID NO: 5432) |
| 367_D02 | DDYSMN (SEQ ID NO: 4588) | WVSNINYNGGYTS (SEQ ID NO: 4757) | ARSATWHDTHLD (SEQ ID NO: 4926) | VTYVNWY (SEQ ID NO: 5095) | LLIYAATSRA (SEQ ID NO: 5264) | QQSYENPL (SEQ ID NO: 5433) |
| 374_C07 | DSYSMN (SEQ ID NO: 4589) | WVSNINYNGGYTS (SEQ ID NO: 4758) | ARSATWHDTHLD (SEQ ID NO: 4927) | ISYLNWY (SEQ ID NO: 5096) | LLIYAATSRA (SEQ ID NO: 5265) | QQSDELPL (SEQ ID NO: 5434) |
| 374_A03 | DSYSMN (SEQ ID NO: 4590) | WVSNINYNGGYTS (SEQ ID NO: 4759) | ARSATWHDTHLD (SEQ ID NO: 4928) | LTYLNWY (SEQ ID NO: 5097) | LLIYAATSRA (SEQ ID NO: 5266) | QQSYDNPL (SEQ ID NO: 5435) |
| 365_A02 | DSYSMN (SEQ ID NO: 4591) | WVSNINYNGGYTS (SEQ ID NO: 4760) | ARSATWHDTHLD (SEQ ID NO: 4929) | LTYVNWY (SEQ ID NO: 5098) | LLIYAATSRA (SEQ ID NO: 5267) | QQSYNSPL (SEQ ID NO: 5436) |
| 365_D06 | DSYSMN (SEQ ID NO: 4592) | WVSNINYNGGYTS (SEQ ID NO: 4761) | ARSATWHDTHLD (SEQ ID NO: 4930) | LTYVNWY (SEQ ID NO: 5099) | LLIYAATSRA (SEQ ID NO: 5268) | QQSYSLPL (SEQ ID NO: 5437) |
| 366_C07 | SSYSMN (SEQ ID NO: 4593) | WVSNINYNGGYTS (SEQ ID NO: 4762) | ARSATWHDTHLD (SEQ ID NO: 4931) | LTYVNWY (SEQ ID NO: 5100) | LLIYAATSRA (SEQ ID NO: 5269) | QQSYNSPL (SEQ ID NO: 5438) |
| 367_F12 | DDYSMN (SEQ ID NO: 4594) | WVSNINYNSGYKG (SEQ ID NO: 4763) | ARSATWHDTHLD (SEQ ID NO: 4932) | SSYLNWY (SEQ ID NO: 5101) | LLIYAASSLQ (SEQ ID NO: 5270) | QQSYSTPL (SEQ ID NO: 5439) |
| 369_E09 | DSYSMN (SEQ ID NO: 4595) | WVSNINYNSGYKG (SEQ ID NO: 4764) | ARSATWHDTHLD (SEQ ID NO: 4933) | LSYLNWY (SEQ ID NO: 5102) | LVIYAATSRA (SEQ ID NO: 5271) | QQSYDLPL (SEQ ID NO: 5440) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 365_G02 | SDYSMN (SEQ ID NO: 4596) | WVSNINYNSGYKG (SEQ ID NO: 4765) | ARSATWHDTHLD (SEQ ID NO: 4934) | VTYLNWY (SEQ ID NO: 5103) | LVIYAVTSLH (SEQ ID NO: 5272) | QQSYELPL (SEQ ID NO: 5441) |
| 373_D02 | SSYSMN (SEQ ID NO: 4597) | WVSNINYNSGYKG (SEQ ID NO: 4766) | ARSATWHDTHLD (SEQ ID NO: 4935) | LSYLNWY (SEQ ID NO: 5104) | LLIYAATSLA (SEQ ID NO: 5273) | QQSYDLPL (SEQ ID NO: 5442) |
| 374_E03 | SSYSMN (SEQ ID NO: 4598) | WVSNINYNSGYKG (SEQ ID NO: 4767) | ARSATWHDTHLD (SEQ ID NO: 4936) | LTYVNWY (SEQ ID NO: 5105) | LVIYAATSLA (SEQ ID NO: 5274) | QQSYDTPL (SEQ ID NO: 5443) |
| 374_D11 | DSYGMN (SEQ ID NO: 4599) | WVSNINYNSGYTG (SEQ ID NO: 4768) | ARSATWHDTHLD (SEQ ID NO: 4937) | LTYLNWY (SEQ ID NO: 5106) | LLIYAATSRA (SEQ ID NO: 5275) | QQSYETPL (SEQ ID NO: 5444) |
| 370_D07 | SSYGMN (SEQ ID NO: 4600) | WVSNINYNSGYTG (SEQ ID NO: 4769) | ARSATWHDTHLD (SEQ ID NO: 4938) | LSYVNWY (SEQ ID NO: 5107) | LVIYAATSLA (SEQ ID NO: 5276) | QQSYESPL (SEQ ID NO: 5445) |
| 374_A08 | DSYSMN (SEQ ID NO: 4601) | WVSNINYNSGYTS (SEQ ID NO: 4770) | ARSATWHDTHLD (SEQ ID NO: 4939) | VTYLNWY (SEQ ID NO: 5108) | LLIYAATSLA (SEQ ID NO: 5277) | QQSYDLPL (SEQ ID NO: 5446) |
| 374_G01 | DSYSMN (SEQ ID NO: 4602) | WVSNINYNSGYTS (SEQ ID NO: 4771) | ARSATWHDTHLD (SEQ ID NO: 4940) | LTYVNWY (SEQ ID NO: 5109) | LLIYATTSRH (SEQ ID NO: 5278) | QQSYNLPL (SEQ ID NO: 5447) |
| 374_G12 | DDYGMN (SEQ ID NO: 4603) | WVSSINYNGGYKS (SEQ ID NO: 4772) | ARSATWHDTHLD (SEQ ID NO: 4941) | LTYVNWY (SEQ ID NO: 5110) | LVIYAATSLA (SEQ ID NO: 5279) | QQSYNSPL (SEQ ID NO: 5448) |
| 375_G10 | SSYGMN (SEQ ID NO: 4604) | WVSSINYNGGYKS (SEQ ID NO: 4773) | ARSATWHDTHLD (SEQ ID NO: 4942) | VTYLNWY (SEQ ID NO: 5111) | LVIYAATSRH (SEQ ID NO: 5280) | QQSYDTPL (SEQ ID NO: 5449) |
| 369_H11 | SDYGMN (SEQ ID NO: 4605) | WVSSINYNGGYTG (SEQ ID NO: 4774) | ARSATWHDTHLD (SEQ ID NO: 4943) | LSYLNWY (SEQ ID NO: 5112) | LLIYAATSRH (SEQ ID NO: 5281) | QQSYDLPL (SEQ ID NO: 5450) |
| 375_G12 | DSYGMH (SEQ ID NO: 4606) | WVSSINYNGGYTS (SEQ ID NO: 4775) | ARSATWHDTHLD (SEQ ID NO: 4944) | VSYVNWY (SEQ ID NO: 5113) | LLIYAATSRH (SEQ ID NO: 5282) | QQSYDTPL (SEQ ID NO: 5451) |
| 366_F06 | SDYGMN (SEQ ID NO: 4607) | WVSSINYNGGYTS (SEQ ID NO: 4776) | ARSATWHDTHLD (SEQ ID NO: 4945) | STYLNWY (SEQ ID NO: 5114) | LLIYAATSLA (SEQ ID NO: 5283) | QQSYSNPL (SEQ ID NO: 5452) |
| 368_G07 | SSYSMH (SEQ ID NO: 4608) | WVSSINYNGGYTS (SEQ ID NO: 4777) | ARSATWHDTHLD (SEQ ID NO: 4946) | VSYVNWY (SEQ ID NO: 5115) | LVIYAATSRA (SEQ ID NO: 5284) | QQSYDTPL (SEQ ID NO: 5453) |
| 367_H04 | SSYSMN (SEQ ID NO: 4609) | WVSSINYNGGYTS (SEQ ID NO: 4778) | ARSATWHDTHLD (SEQ ID NO: 4947) | LTYVNWY (SEQ ID NO: 5116) | LLIYAATSRH (SEQ ID NO: 5285) | QQSDNNPL (SEQ ID NO: 5454) |
| 374_E06 | DSYSMN (SEQ ID NO: 4610) | WVSSINYNSGYKG (SEQ ID NO: 4779) | ARSATWHDTHLD (SEQ ID NO: 4948) | LSYLNWY (SEQ ID NO: 5117) | LLIYAATSRA (SEQ ID NO: 5286) | QQSYDLPL (SEQ ID NO: 5455) |

TABLE 3F-continued

CDR sequences for Group VI antibodies

| Ab | HCDR1 | HCDR2 | HCDR3 | LCDR1 | LCDR2 | LCDR3 |
|---|---|---|---|---|---|---|
| 370_A10 | SDYSMN (SEQ ID NO: 4611) | WVSSINYNSGYKG (SEQ ID NO: 4780) | ARSATWHDTHLD (SEQ ID NO: 4949) | LSYVNWY (SEQ ID NO: 5118) | LLIYAATSLA (SEQ ID NO: 5287) | QQSYDTPL (SEQ ID NO: 5456) |
| 368_H10 | SSYSMN (SEQ ID NO: 4612) | WVSSINYNSGYKG (SEQ ID NO: 4781) | ARSATWHDTHLD (SEQ ID NO: 4950) | VSYVNWY (SEQ ID NO: 5119) | LVIYAVTSLA (SEQ ID NO: 5288) | QQSYETPL (SEQ ID NO: 5457) |
| 368_G08 | DDYGMN (SEQ ID NO: 4613) | WVSSINYNSGYKS (SEQ ID NO: 4782) | ARSATWHDTHLD (SEQ ID NO: 4951) | VSYVNWY (SEQ ID NO: 5120) | LLIYAATSRH (SEQ ID NO: 5289) | QQSYNNPL (SEQ ID NO: 5458) |
| 365_H09 | SSYGMN (SEQ ID NO: 4614) | WVSSINYNSGYKS (SEQ ID NO: 4783) | ARSATWHDTHLD (SEQ ID NO: 4952) | SSYLNWY (SEQ ID NO: 5121) | LLIYAASSLQ (SEQ ID NO: 5290) | QQSYSTPL (SEQ ID NO: 5459) |
| 370_A08 | DSYSMN (SEQ ID NO: 4615) | WVSSINYNSGYTG (SEQ ID NO: 4784) | ARSATWHDTHLD (SEQ ID NO: 4953) | VTYLNWY (SEQ ID NO: 5122) | LVIYAATSRA (SEQ ID NO: 5291) | QQSYDLPL (SEQ ID NO: 5460) |
| 368_B05 | DSYSMN (SEQ ID NO: 4616) | WVSSINYNSGYTG (SEQ ID NO: 4785) | ARSATWHDTHLD (SEQ ID NO: 4954) | SSYLNWY (SEQ ID NO: 5123) | LLIYAASSLQ (SEQ ID NO: 5292) | QQSYSTPL (SEQ ID NO: 5461) |
| 375_F01 | SSYSMN (SEQ ID NO: 4617) | WVSSINYNSGYTG (SEQ ID NO: 4786) | ARSATWHDTHLD (SEQ ID NO: 4955) | VSYLNWY (SEQ ID NO: 5124) | LVIYAATSRA (SEQ ID NO: 5293) | QQSYDNPL (SEQ ID NO: 5462) |
| 374_F09 | SSYGMN (SEQ ID NO: 4618) | WVSSINYNSGYTS (SEQ ID NO: 4787) | ARSATWHDTHLD (SEQ ID NO: 4956) | SSYVNWY (SEQ ID NO: 5125) | LLIYAATSRA (SEQ ID NO: 5294) | QQSYSTPL (SEQ ID NO: 5463) |

The consensus sequences for each of these CDRs shown in FIG. 3F are as follows:

```
HCDR1:
                                        (SEQ ID NO: 6584)
D/SS/DYS/GMN/H

HCDR2:
                                        (SEQ ID NO: 6585)
WVA/SG/N/SINYNG/SGYT/KS/G

HCDR3:
                                        (SEQ ID NO: 6586)
ARSATWHDTH/ALD

LCDR1:
                                        (SEQ ID NO: 6588)
L/V/I/SS/T/RYL/VNWY

LCDR2:
                                        (SEQ ID NO: 6590)
LL/VIYA/YA/V/TT/SS/NR/LA/H/Q

LCDR3:
                                        (SEQ ID NO: 6591)
QQSY/DD/E/S/NL/N/T/SPL
```

The present antibody may exhibit high affinity binding to ACVR2A. For example, the antibody may binds to ACVR2 with an affinity of at least about $10^{-7}$ M, at least about $10^{-8}$ M, at least about $10^{-9}$ M, at least about $10^{-10}$ M, at least about $10^{-11}$ M, or at least about $10^{-12}$ M, or greater than $10^{-12}$ M. The present antibody binds to ACVR2A with a substantially lower affinity, e.g., at least 10 fold, 50 fold, 100 fold, 500 fold, 1000 fold, 5000 fold, 10,000 fold, 50,000 fold 100,000, or 500,000 fold lower affinity.

The present antibody may reduce binding of ACVR2A to GDF8 and/or other activins. For example, the antibody may reduce binding of ACVR2A to GDF8 and/or other activins by at least about 5%, at least about 10%, at least about 15%, at least about 20%, at least about 25%, at least about 30%, at least about 40%, at least about 50%, at least about 60%, at least about 70%, at least about 80%, at least about 90%, or more, compared to the degree of binding between ACVR2A and GDF8 and/or other activins in the absence of the antibody.

In some embodiments, an antibody comprises one or more (e.g., one or two) heavy chain variable regions (VH) and/or one or more (e.g., one or two) light chain variable regions (VL), or subfragments thereof capable of binding an epitope. The VH and VL regions can be further subdivided into regions of hypervariability, termed "complementarity determining regions (CDR)", interspersed with regions that are more conserved, termed "framework regions (FR)". The extent of the FR and CDRs has been precisely defined (see, Kabat, et al. (1991) Sequences of Proteins of Immunological Interest, Fifth Edition, U.S. Department of Health and Human Services, NIH Publication No. 91-3242; Chothia et al. (1987) J. Mol. Biol. 196: 901-917). A VH can comprise three CDRs and four FRs arranged from N-terminus to C-terminus in the following order: FR1, CDR1, FR2, CDR2, FR3, CDR3, FR4. Similarly, a VL can comprise three CDRs and four FRs arranged from N-terminus to C-terminus in the following order: FR1, CDR1, FR2, CDR2, FR3, CDR3, FR4.

The VH or VL chain of an antibody can further include all or part of a heavy or light chain constant region, to thereby form a heavy or light immunoglobulin chain, respectively. In one embodiment, the antibody is a tetramer of two heavy and two light chains, wherein the heavy and light chains are interconnected by, for example, disulphide bonds. The heavy chain constant region is comprised of three domains, CH1, CH2 and CH3. The light chain constant region is comprised of one domain, CL. The variable regions of the heavy and light chains comprise binding regions that interact with antigen. The constant regions of the antibodies typically mediate the binding of the antibody to host tissues and factors, including various cells of the immune system and the first component of the complement system. The term "antibody" includes intact immunoglobulins of types IgA, IgG, IgE, IgD, IgM and subtypes thereof. In some embodiments, a subject antibody is an IgG isotype.

As used herein the term "immunoglobulin" refers to a protein consisting of one or more polypeptides substantially encoded by immunoglobulin genes. The recognized human immunoglobulin genes include the kappa, lambda, alpha (IgA1 and IgA2), gamma (IgG1, IgG2, IgG3, IgG4), delta, epsilon and mu constant region genes; and numerous immunoglobulin variable region genes. Full-length immunoglobulin light chains (about 25 kD or 214 amino acids) are encoded by a variable region gene at the N-terminus (about 110 amino acids) and a kappa or lambda constant region at the C-terminus. Full-length immunoglobulin heavy chains (about 50 kD or 446 amino acids) are encoded by a variable region gene at the N-terminus (about 116 amino acids) and one of the other aforementioned constant region genes at the C-terminus, e.g. gamma (encoding about 330 amino acids). In some embodiments, a subject antibody comprises full-length immunoglobulin heavy chain and a full-length immunoglobulin light chain.

In some embodiments, a subject antibody does not comprise a full-length immunoglobulin heavy chain and a full-length immunoglobulin light chain, and instead comprises antigen-binding fragments of a full-length immunoglobulin heavy chain and a full-length immunoglobulin light chain. In some embodiments, the antigen-binding fragments are contained on separate polypeptide chains; in other embodiments, the antigen-binding fragments are contained within a single polypeptide chain. The term "antigen-binding fragment" refers to one or more fragments of a full-length antibody that are capable of specifically binding to ACVR2A as described above. Examples of binding fragments include (i) a Fab fragment (a monovalent fragment consisting of the VL, VH, CL and CH1 domains; (ii) a F(ab')$_2$ fragment (a bivalent fragment comprising two Fab fragments linked by a disulfide bridge at the hinge region; (iii) a Fd fragment (consisting of the VH and CH1 domains); (iv) a Fv fragment (consisting of the VH and VL domains of a single arm of an antibody); (v) a dAb fragment (consisting of the VH domain); (vi) an isolated CDR; (vii) a single chain Fv (scFv) (consisting of the VH and VL domains of a single arm of an antibody joined by a synthetic linker using recombinant means such that the VH and VL domains pair to form a monovalent molecule); (viii) diabodies (consisting of two scFvs in which the VH and VL domains are joined such that they do not pair to form a monovalent molecule; the VH of each one of the scFv pairs with the VL domain of the other scFv to form a bivalent molecule); (ix) bi-specific antibodies (consisting of at least two antigen binding regions, each region binding a different epitope). In some embodiments, a subject antibody fragment is a Fab fragment. In some embodiments, a subject antibody fragment is a single-chain antibody (scFv).

In some embodiments, a subject antibody is a recombinant or modified antibody, e.g., a chimeric, humanized, deimmunized or an in vitro generated antibody. The term "recombinant" or "modified" antibody as used herein is intended to include all antibodies that are prepared, expressed, created, or isolated by recombinant means, such as (i) antibodies expressed using a recombinant expression vector transfected into a host cell; (ii) antibodies isolated from a recombinant, combinatorial antibody library; (iii) antibodies isolated from an animal (e.g. a mouse) that is transgenic for human immunoglobulin genes; or (iv) antibodies prepared, expressed, created, or isolated by any other means that involves splicing of human immunoglobulin gene sequences to other DNA sequences. Such recombinant antibodies include humanized, CDR grafted, chimeric, deimmunized, and in vitro generated antibodies; and can optionally include constant regions derived from human germline immunoglobulin sequences.

In some embodiments, a subject antibody comprises, in order from N-terminus to C-terminus: a light chain FR1 region; a CDR1; a light chain FR2 region; a CDR2; a light chain FR3 region; a CDR3; optionally a light chain FR4 region; a linker region; optionally a heavy chain FR1 region; a CDR1; a heavy chain FR2 region; a CDR2; a heavy chain FR3 region; a CDR3; and a heavy chain FR4 region. In some of these embodiments, each of the FR regions is a human FR region. The linker region can be from about 5 amino acids to about 50 amino acids in length, e.g., from about 5 aa to about 10 aa, from about 10 aa to about 15 aa, from about 15 aa to about 20 aa, from about 20 aa to about 25 aa, from about 25 aa to about 30 aa, from about 30 aa to about 35 aa, from about 35 aa to about 40 aa, from about 40 aa to about 45 aa, or from about 45 aa to about 50 aa in length.

Linkers suitable for use a subject antibody include "flexible linkers". If present, the linker molecules are generally of sufficient length to permit some flexible movement between linked regions. The linker molecules are generally about 6-50 atoms long. The linker molecules may also be, for example, aryl acetylene, ethylene glycol oligomers containing 2-10 monomer units, diamines, diacids, amino acids, or combinations thereof. Other linker molecules which can bind to polypeptides may be used in light of this disclosure.

Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, or 7 amino acids.

Exemplary flexible linkers include glycine polymers $(G)_n$, glycine-serine polymers (including, for example, $(GS)_n$, $GSGGS_n$ (SEQ ID NO: 6599) and $GGGS_n$ (SEQ ID NO: 6600), where n is an integer of at least one), glycine-alanine polymers, alanine-serine polymers, and other flexible linkers known in the art. Glycine and glycine-serine polymers are of interest since both of these amino acids are relatively unstructured, and therefore may serve as a neutral tether between components. Glycine polymers are of particular interest since glycine accesses significantly more phi-psi space than even alanine, and is much less restricted than residues with longer side chains (see Scheraga, *Rev. Computational Chem.* 11173-142 (1992)). Exemplary flexible linkers include, but are not limited GGSG (SEQ ID NO:6601), GGSGG (SEQ ID NO:6602), GSGSG (SEQ ID NO: 6603), GSGGG (SEQ ID NO:6604), GGGSG (SEQ ID NO: 6605), GSSSG (SEQ ID NO: 6606), and the like. The ordinarily skilled artisan will recognize that design of a peptide conjugated to any elements described above can include linkers that are all or partially flexible, such that the linker can include a flexible linker as well as one or more portions that confer less flexible structure.

In some embodiments, a subject antibody is "humanized" The term "humanized antibody" refers to an antibody comprising at least one chain comprising variable region framework residues substantially from a human antibody chain (referred to as the acceptor immunoglobulin or antibody) and at least one CDR substantially from a mouse antibody, (referred to as the donor immunoglobulin or antibody). See, Queen et al., Proc. Natl. Acad. Sci. USA 86:10029 10033 (1989), U.S. Pat. Nos. 5,530,101, 5,585,089, 5,693,761, WO 90/07861, and U.S. Pat. No. 5,225,539. The constant region(s), if present, can also be substantially or entirely from a human immunoglobulin. In some embodiments, a subject antibody may comprise one or more CDRs and one or more FR regions from a human antibody. Methods of making humanized antibodies are known in the art. See, e.g., U.S. Pat. No. 7,256,273.

The substitution of mouse CDRs into a human variable domain framework can result in retention of their correct spatial orientation where, e.g., the human variable domain framework adopts the same or similar conformation to the mouse variable framework from which the CDRs originated. This can be achieved by obtaining the human variable domains from human antibodies whose framework sequences exhibit a high degree of sequence identity with the murine variable framework domains from which the CDRs were derived. The heavy and light chain variable framework regions can be derived from the same or different human antibody sequences. The human antibody sequences can be the sequences of naturally occurring human antibodies or can be consensus sequences of several human antibodies. See Kettleborough et al., Protein Engineering 4:773 (1991); Kolbinger et al., Protein Engineering 6:971 (1993).

Having identified the complementarity determining regions of the murine donor immunoglobulin and appropriate human acceptor immunoglobulins, the next step is to determine which, if any, residues from these components should be substituted to optimize the properties of the resulting humanized antibody. In general, substitution of human amino acid residues with murine should be minimized, because introduction of murine residues increases the risk of the antibody eliciting a human-anti-mouse-antibody (HAMA) response in humans. Art-recognized methods of determining immune response can be performed to monitor a HAMA response in a particular patient or during clinical trials. Patients administered humanized antibodies can be given an immunogenicity assessment at the beginning and throughout the administration of the therapy. The HAMA response is measured, for example, by detecting antibodies to the humanized therapeutic reagent, in serum samples from the patient using a method known to one in the art, including surface plasmon resonance technology (BIACORE) and/or solid-phase ELISA analysis. In many embodiments, a subject humanized antibody does not substantially elicit a HAMA response in a human subject.

Certain amino acids from the human variable region framework residues are selected for substitution based on their possible influence on CDR conformation and/or binding to antigen. The unnatural juxtaposition of murine CDR regions with human variable framework region can result in unnatural conformational restraints, which, unless corrected by substitution of certain amino acid residues, lead to loss of binding affinity.

The selection of amino acid residues for substitution can be determined, in part, by computer modeling. Computer hardware and software for producing three-dimensional images of immunoglobulin molecules are known in the art. In general, molecular models are produced starting from solved structures for immunoglobulin chains or domains thereof. The chains to be modeled are compared for amino acid sequence similarity with chains or domains of solved three-dimensional structures, and the chains or domains showing the greatest sequence similarity is/are selected as starting points for construction of the molecular model. Chains or domains sharing at least 50% sequence identity are selected for modeling, and preferably those sharing at least 60%, 70%, 80%, 90% sequence identity or more are selected for modeling. The solved starting structures are modified to allow for differences between the actual amino acids in the immunoglobulin chains or domains being modeled, and those in the starting structure. The modified structures are then assembled into a composite immunoglobulin. Finally, the model is refined by energy minimization and by verifying that all atoms are within appropriate distances from one another and that bond lengths and angles are within chemically acceptable limits.

CDR and framework regions are as defined by Kabat, Sequences of Proteins of Immunological Interest (National Institutes of Health, Bethesda, Md., 1987 and 1991). An alternative structural definition has been proposed by Chothia et al., J. Mol. Biol. 196:901 (1987); Nature 342:878 (1989); and J. Mol. Biol. 186:651 (1989) (collectively referred to as "Chothia"). When framework residues, as defined by Kabat, supra, constitute structural loop residues as defined by Chothia, supra, the amino acids present in the mouse antibody may be selected for substitution into the humanized antibody. Residues which are "adjacent to a CDR region" include amino acid residues in positions immediately adjacent to one or more of the CDRs in the primary sequence of the humanized immunoglobulin chain, for example, in positions immediately adjacent to a CDR as defined by Kabat, or a CDR as defined by Chothia (See e.g., Chothia and Lesk J M B 196:901 (1987)). These amino acids are particularly likely to interact with the amino acids in the CDRs and, if chosen from the acceptor, to distort the donor CDRs and reduce affinity. Moreover, the adjacent amino acids may interact directly with the antigen (Amit et al., Science, 233:747 (1986)) and selecting these amino acids from the donor may be desirable to keep all the antigen contacts that provide affinity in the original antibody.

In some embodiments, a subject antibody comprises scFv multimers. For example, in some embodiments, a subject antibody is an scFv dimer (e.g., comprises two tandem scFv ($scFv_2$)), an scFv trimer (e.g., comprises three tandem scFv ($scFv_3$)), an scFv tetramer (e.g., comprises four tandem scFv ($scFv_4$)), or is a multimer of more than four scFv (e.g., in tandem). The scFv monomers can be linked in tandem via linkers of from about 2 amino acids to about 10 amino acids in length, e.g., 2 aa, 3 aa, 4 aa, 5 aa, 6 aa, 7 aa, 8 aa, 9 aa, or 10 aa in length. Suitable linkers include, e.g., $(Gly)_x$, where x is an integer from 2 to 10. Other suitable linkers are those discussed above. In some embodiments, each of the scFv monomers in a subject scFV multimer is humanized, as described above.

In some embodiments, a subject antibody comprises a constant region of an immunoglobulin (e.g., an Fc region). The Fc region, if present, can be a human Fc region. If constant regions are present, the antibody can contain both light chain and heavy chain constant regions. Suitable heavy chain constant region include CH1, hinge, CH2, CH3, and CH4 regions. The antibodies described herein include antibodies having all types of constant regions, including IgM, IgG, IgD, IgA and IgE, and any isotype, including IgG1, IgG2, IgG3 and IgG4. An example of a suitable heavy chain Fc region is a human isotype IgG1 Fc. Light chain constant regions can be lambda or kappa. A subject antibody (e.g., a subject humanized antibody) can comprise sequences from more than one class or isotype. Antibodies can be expressed as tetramers containing two light and two heavy chains, as separate heavy chains, light chains, as Fab, Fab' F(ab')2, and Fv, or as single chain antibodies in which heavy and light chain variable domains are linked through a spacer.

In some embodiments, a subject antibody comprises a free thiol (—SH) group at the carboxyl terminus, where the free thiol group can be used to attach the antibody to a second polypeptide (e.g., another antibody, including a subject antibody), a scaffold, a carrier, etc.

In some embodiments, a subject antibody comprises one or more non-naturally occurring amino acids. In some embodiments, the non-naturally encoded amino acid comprises a carbonyl group, an acetyl group, an aminooxy group, a hydrazine group, a hydrazide group, a semicarbazide group, an azide group, or an alkyne group. See, e.g., U.S. Pat. No. 7,632,924 for suitable non-naturally occurring amino acids. Inclusion of a non-naturally occurring amino acid can provide for linkage to a polymer, a second polypeptide, a scaffold, etc. For example, a subject antibody linked to a water-soluble polymer can be made by reacting a water-soluble polymer (e.g., PEG) that comprises a carbonyl group to an the subject antibody that comprises a non-naturally encoded amino acid that comprises an aminooxy, hydrazine, hydrazide or semicarbazide group. As another example, a subject antibody linked to a water-soluble polymer can be made by reacting a subject antibody that comprises an alkyne-containing amino acid with a water-soluble polymer (e.g., PEG) that comprises an azide moiety; in some embodiments, the azide or alkyne group is linked to the PEG molecule through an amide linkage. A "non-naturally encoded amino acid" refers to an amino acid that is not one of the 20 common amino acids or pyrolysine or selenocysteine. Other terms that may be used synonymously with the term "non-naturally encoded amino acid" are "non-natural amino acid," "unnatural amino acid," "non-naturally-occurring amino acid," and variously hyphenated and non-hyphenated versions thereof. The term "non-naturally encoded amino acid" also includes, but is not limited to, amino acids that occur by modification (e.g. post-translational modifications) of a naturally encoded amino acid (including but not limited to, the 20 common amino acids or pyrolysine and selenocysteine) but are not themselves naturally incorporated into a growing polypeptide chain by the translation complex. Examples of such non-naturally-occurring amino acids include, but are not limited to, N-acetylglucosaminyl-L-serine, N-acetylglucosaminyl-L-threonine, and O-phosphotyrosine.

In some embodiments, a subject antibody is linked (e.g., covalently linked) to a polymer (e.g., a polymer other than a polypeptide). Suitable polymers include, e.g., biocompatible polymers, and water-soluble biocompatible polymers. Suitable polymers include synthetic polymers and naturally-occurring polymers. Suitable polymers include, e.g., substituted or unsubstituted straight or branched chain polyalkylene, polyalkenylene or polyoxyalkylene polymers or branched or unbranched polysaccharides, e.g. a homo- or hetero-polysaccharide. Suitable polymers include, e.g., ethylene vinyl alcohol copolymer (commonly known by the generic name EVOH or by the trade name EVAL); polybutylmethacrylate; poly(hydroxyvalerate); poly(L-lactic acid); polycaprolactone; poly(lactide-co-glycolide); poly (hydroxybutyrate); poly(hydroxybutyrate-co-valerate); polydioxanone; polyorthoester; polyanhydride; poly(glycolic acid); poly(D,L-lactic acid); poly(glycolic acid-co-trimethylene carbonate); polyphosphoester; polyphosphoester urethane; poly(amino acids); cyanoacrylates; poly (trimethylene carbonate); poly(iminocarbonate); copoly (ether-esters) (e.g., poly(ethylene oxide)-poly(lactic acid) (PEO/PLA) co-polymers); polyalkylene oxalates; polyphosphazenes; biomolecules, such as fibrin, fibrinogen, cellulose, starch, collagen and hyaluronic acid; polyurethanes; silicones; polyesters; polyolefins; polyisobutylene and ethylene-alphaolefin copolymers; acrylic polymers and copolymers; vinyl halide polymers and copolymers, such as polyvinyl chloride; polyvinyl ethers, such as polyvinyl methyl ether; polyvinylidene halides, such as polyvinylidene fluoride and polyvinylidene chloride; polyacrylonitrile; polyvinyl ketones; polyvinyl aromatics, such as polystyrene; polyvinyl esters, such as polyvinyl acetate; copolymers of vinyl monomers with each other and olefins, such as ethylene-methyl methacrylate copolymers, acrylonitrile-styrene copolymers, ABS resins, and ethylene-vinyl acetate copolymers; polyamides, such as Nylon 66 and polycaprolactam; alkyd resins; polycarbonates; polyoxymethylenes; polyimides; polyethers; epoxy resins; polyurethanes; rayon; rayon-triacetate; cellulose; cellulose acetate; cellulose butyrate; cellulose acetate butyrate; cellophane; cellulose nitrate; cellulose propionate; cellulose ethers; amorphous Teflon; poly (ethylene glycol); and carboxymethyl cellulose.

Suitable synthetic polymers include unsubstituted and substituted straight or branched chain poly(ethyleneglycol), poly(propyleneglycol) poly(vinylalcohol), and derivatives thereof, e.g., substituted poly(ethyleneglycol) such as methoxypoly(ethyleneglycol), and derivatives thereof. Suitable naturally-occurring polymers include, e.g., albumin, amylose, dextran, glycogen, and derivatives thereof.

Suitable polymers can have an average molecular weight in a range of from 500 Da to 50000 Da, e.g., from 5000 Da to 40000 Da, or from 25000 to 40000 Da. For example, in some embodiments, where a subject antibody comprises a poly(ethylene glycol) (PEG) or methoxypoly(ethyleneglycol) polymer, the PEG or methoxypoly(ethyleneglycol) polymer can have a molecular weight in a range of from about 0.5 kiloDaltons (kDa) to 1 kDa, from about 1 kDa to 5 kDa, from 5 kDa to 10 kDa, from 10 kDa to 25 kDa, from 25 kDa to 40 kDa, or from 40 kDa to 60 kDa.

As noted above, in some embodiments, a subject antibody is covalently linked to a PEG polymer. In some embodiments, a subject scFv multimer is covalently linked to a PEG polymer. See, e.g., Albrecht et al. (2006) *J. Immunol. Methods* 310:100. Methods and reagents suitable for PEGylation of a protein are well known in the art and may be found in, e.g., U.S. Pat. No. 5,849,860. PEG suitable for conjugation to a protein is generally soluble in water at room temperature, and has the general formula RO—$CH_2$—$CH_2)_n$O—R, where R is hydrogen or a protective group such as an alkyl or an alkanol group, and where n is an integer from 1 to 1000. Where R is a protective group, it generally has from 1 to 8 carbons.

The PEG conjugated to the subject antibody can be linear. The PEG conjugated to the subject protein may also be branched. Branched PEG derivatives such as those described in U.S. Pat. No. 5,643,575, "star-PEG's" and multi-armed PEG's such as those described in Shearwater Polymers, Inc. catalog "Polyethylene Glycol Derivatives 1997-1998." Star PEGs are described in the art including, e.g., in U.S. Pat. No. 6,046,305.

A subject antibody can be glycosylated, e.g., comprise a covalently linked carbohydrate or polysaccharide moiety. Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition of glycosylation sites to an antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites). Similarly, removal of glycosylation sites can be accomplished by amino acid alteration within the native glycosylation sites of an antibody.

A subject antibody will in some embodiments comprise a "radiopaque" label, e.g. a label that can be easily visualized using for example x-rays. Radiopaque materials are well known to those of skill in the art. The most common radiopaque materials include iodide, bromide or barium salts. Other radiopaque materials are also known and include, but are not limited to organic bismuth derivatives (see, e.g., U.S. Pat. No. 5,939,045), radiopaque multiurethanes (see U.S. Pat. No. 5,346,981), organobismuth composites (see, e.g., U.S. Pat. No. 5,256,334), radiopaque barium multimer complexes (see, e.g., U.S. Pat. No. 4,866, 132), and the like.

A subject antibody can be covalently linked to a second moiety (e.g., a lipid, a polypeptide other than a subject antibody, a synthetic polymer, a carbohydrate, and the like) using for example, glutaraldehyde, a homobifunctional cross-linker, or a heterobifunctional cross-linker. Glutaraldehyde cross-links polypeptides via their amino moieties. Homobifunctional cross-linkers (e.g., a homobifunctional imidoester, a homobifunctional N-hydroxysuccinimidyl (NHS) ester, or a homobifunctional sulfhydryl reactive cross-linker) contain two or more identical reactive moieties and can be used in a one step reaction procedure in which the cross-linker is added to a solution containing a mixture of the polypeptides to be linked. Homobifunctional NHS ester and imido esters cross-link amine containing polypeptides. In a mild alkaline pH, imido esters react only with primary amines to form imidoamides, and overall charge of the cross-linked polypeptides is not affected. Homobifunctional sulfhydryl reactive cross-linkers includes bismaleimidhexane (BMH), 1,5-difluoro-2,4-dinitrobenzene (DFDNB), and 1,4-di-(3',2'-pyridyldithio) propinoamido butane (DPDPB).

Heterobifunctional cross-linkers have two or more different reactive moieties (e g, amine reactive moiety and a sulfhydryl-reactive moiety) and are cross-linked with one of the polypeptides via the amine or sulfhydryl reactive moiety, then reacted with the other polypeptide via the non-reacted moiety. Multiple heterobifunctional haloacetyl cross-linkers are available, as are pyridyl disulfide cross-linkers. Carbodiimides are a classic example of heterobifunctional cross-linking reagents for coupling carboxyls to amines, which results in an amide bond.

A subject antibody can be immobilized on a solid support. Suitable supports are well known in the art and comprise, inter alia, commercially available column materials, polystyrene beads, latex beads, magnetic beads, colloid metal particles, glass and/or silicon chips and surfaces, nitrocellulose strips, nylon membranes, sheets, duracytes, wells of reaction trays (e.g., multi-well plates), plastic tubes, etc. A solid support can comprise any of a variety of substances, including, e.g., glass, polystyrene, polyvinyl chloride, polypropylene, polyethylene, polycarbonate, dextran, nylon, amylose, natural and modified celluloses, polyacrylamides, agaroses, and magnetite. Suitable methods for immobilizing a subject antibody onto a solid support are well known and include, but are not limited to ionic, hydrophobic, covalent interactions and the like. Solid supports can be soluble or insoluble, e.g., in aqueous solution. In some embodiments, a suitable solid support is generally insoluble in an aqueous solution.

A subject antibody will in some embodiments comprise a detectable label. Suitable detectable labels include any composition detectable by spectroscopic, photochemical, biochemical, immunochemical, electrical, optical or chemical means. Suitable include, but are not limited to, magnetic beads (e.g. Dynabeads™), fluorescent dyes (e.g., fluorescein isothiocyanate, texas red, rhodamine, a green fluorescent protein, a red fluorescent protein, a yellow fluorescent protein, and the like), radiolabels (e.g., $^3$H, $^{125}$I, $^{35}$S, $^{14}$C, or $^{32}$P), enzymes (e.g., horse radish peroxidase, alkaline phosphatase, luciferase, and others commonly used in an enzyme-linked immunosorbent assay (ELISA)), and colorimetric labels such as colloidal gold or colored glass or plastic (e.g. polystyrene, polypropylene, latex, etc.) beads.

In some embodiments, a subject antibody comprises a contrast agent or a radioisotope, where the contrast agent or radioisotope is one that is suitable for use in imaging, e.g., imaging procedures carried out on humans. Non-limiting examples of labels include radioisotope such as $^{1231}$I (iodine), $^{18}$F (fluorine), $^{99}$Tc (technetium), $^{111}$In (indium), and $^{67}$Ga (gallium), and contrast agent such as gadolinium (Gd), dysprosium, and iron. Radioactive Gd isotopes ($^{153}$Gd) also are available and suitable for imaging procedures in non-human mammals. A subject antibody can be labeled using standard techniques. For example, a subject antibody can be iodinated using chloramine T or 1,3,4,6-tetrachloro-3α,6α-dephenylglycouril. For fluorination, fluorine is added to a subject antibody during the synthesis by a fluoride ion displacement reaction. See, Muller-Gartner, H., TIB Tech., 16:122-130 (1998) and Saji, H., Crit. Rev. Ther. Drug Carrier Syst., 16(2):209-244 (1999) for a review of synthesis of proteins with such radioisotopes. A subject antibody can also be labeled with a contrast agent through standard techniques. For example, a subject antibody can be labeled with Gd by conjugating low molecular Gd chelates such as Gd diethylene triamine pentaacetic acid (GdDTPA) or Gd tetraazacyclododecanetetraacetic (GdDOTA) to the antibody. See, Caravan et al., Chem. Rev. 99:2293-2352 (1999) and Lauffer et al., J. Magn. Reson. Imaging, 3:11-16 (1985).

A subject antibody can be labeled with Gd by, for example, conjugating polylysine-Gd chelates to the antibody. See, for example, Curtet et al., Invest. Radiol., 33(10):752-761 (1998). Alternatively, a subject antibody can be labeled with Gd by incubating paramagnetic polymerized liposomes that include Gd chelator lipid with avidin and biotinylated antibody. See, for example, Sipkins et al., Nature Med., 4:623-626 (1998).

Suitable fluorescent proteins that can be linked to a subject antibody include, but are not limited to, a green fluorescent protein from *Aequoria victoria* or a mutant or derivative thereof e.g., as described in U.S. Pat. Nos. 6,066,476; 6,020,192; 5,985,577; 5,976,796; 5,968,750; 5,968,738; 5,958,713; 5,919,445; 5,874,304; e.g., Enhanced GFP, many such GFP which are available commercially, e.g., from Clontech, Inc.; a red fluorescent protein; a yellow fluorescent protein; any of a variety of fluorescent and colored proteins from *Anthozoan* species, as described in, e.g., Matz et al. (1999) *Nature Biotechnol.* 17:969-973; and the like.

A subject antibody will in some embodiments be linked to (e.g., covalently or non-covalently linked) a fusion partner, e.g., a ligand; an epitope tag; a peptide; a protein other than an antibody; and the like. Suitable fusion partners include peptides and polypeptides that confer enhanced stability in vivo (e.g., enhanced serum half-life); provide ease of purification, e.g., $(His)_n$, e.g., 6His, and the like; provide for secretion of the fusion protein from a cell; provide an epitope tag, e.g., GST, hemagglutinin (HA; e.g., CYPYDVPDYA; SEQ ID NO:6607), FLAG (e.g., DYKDDDDK; SEQ ID NO:6608), c-myc (e.g., CEQKLISEEDL; SEQ ID NO:6609), and the like; provide a detectable signal, e.g., an enzyme that generates a detectable product (e.g., β-galactosidase, luciferase), or a protein that is itself detectable, e.g., a green fluorescent protein, a red fluorescent protein, a yellow fluorescent protein, etc.; provides for multimerization, e.g., a multimerization domain such as an Fc portion of an immunoglobulin; and the like.

The fusion may also include an affinity domain, including peptide sequences that can interact with a binding partner, e.g., such as one immobilized on a solid support, useful for identification or purification. Consecutive single amino acids, such as histidine, when fused to a protein, can be used for one-step purification of the fusion protein by high affinity binding to a resin column, such as nickel sepharose. Exemplary affinity domains include HisS (HHHHH) (SEQ ID NO:6610), HisX6 (HHHHHH) (SEQ ID NO:6611), C-myc (EQKLISEEDL) (SEQ ID NO:6612), Flag (DYKDDDDK) (SEQ ID NO:6608), StrepTag (WSHPQFEK) (SEQ ID NO:6613), hemagglutinin, e.g., HA Tag (YPYDVPDYA; SEQ ID NO:6614), glutathinone-S-transferase (GST), thioredoxin, cellulose binding domain, RYIRS (SEQ ID NO:6615), Phe-His-His-Thr (SEQ ID NO:6616), chitin binding domain, S-peptide, T7 peptide, SH2 domain, C-end RNA tag, WEAAAREACCRECCARA (SEQ ID NO:6617), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, S100 proteins, parvalbumin, calbindin D9K, calbindin D28K, and calretinin, inteins, biotin, streptavidin, MyoD, leucine zipper sequences, and maltose binding protein.

A subject antibody will in some embodiments be fused to a polypeptide that binds to an endogenous blood brain barrier (BBB) receptor Linking a subject antibody to a polypeptide that binds to an endogenous BBB receptor facilitates crossing the BBB, e.g., in a subject treatment method (see below) involving administration of a subject antibody to an individual in need thereof. Suitable polypeptides that bind to an endogenous BBB include antibodies, e.g., monoclonal antibodies, or antigen-binding fragments thereof, that specifically bind to an endogenous BBB receptor. Suitable endogenous BBB receptors include, but are not limited to, an insulin receptor, a transferrin receptor, a leptin receptor, a lipoprotein receptor, and an insulin-like growth factor receptor. See, e.g., U.S. Patent Publication No. 2009/0156498.

In some embodiments, a subject antibody comprises a polyamine modification. Polyamine modification of a subject antibody enhances permeability of the modified antibody at the BBB. A subject antibody can be modified with polyamines that are either naturally occurring or synthetic. See, for example, U.S. Pat. No. 5,670,477. Useful naturally occurring polyamines include putrescine, spermidine, spermine, 1,3-deaminopropane, norspermidine, syn-homospermidine, thermine, thermospermine, caldopentamine, homocaldopentamine, and canavalmine. Putrescine, spermidine and spermine are particularly useful. Synthetic polyamines are composed of the empirical formula $C_xH_yN_z$, can be cyclic or acyclic, branched or unbranched, hydrocarbon chains of 3-12 carbon atoms that further include 1-6 NR or $N(R)_2$ moieties, wherein R is H, $(C_1-C_4)$ alkyl, phenyl, or benzyl. Polyamines can be linked to an antibody using any standard crosslinking method.

In some embodiments, a subject antibody is modified to include a carbohydrate moiety, where the carbohydrate moiety can be covalently linked to the antibody. In some embodiments, a subject antibody is modified to include a lipid moiety, where the lipid moiety can be covalently linked to the antibody. Suitable lipid moieties include, e.g., an N-fatty acyl group such as N-lauroyl, N-oleoyl, etc.; a fatty amine such as dodecyl amine, oleoyl amine, etc.; a C3-C16 long-chain aliphatic lipid; and the like. See, e.g., U.S. Pat. No. 6,638,513). In some embodiments, a subject antibody is incorporated into a liposome.

Methods of Producing a Subject Antibody

The present antibody can be produced by any known method, e.g., conventional synthetic methods for protein synthesis; recombinant DNA methods; etc.

Where a subject antibody is a single chain polypeptide, it can synthesized using standard chemical peptide synthesis techniques. Where a polypeptide is chemically synthesized, the synthesis may proceed via liquid-phase or solid-phase. Solid phase polypeptide synthesis (SPPS), in which the C-terminal amino acid of the sequence is attached to an insoluble support followed by sequential addition of the remaining amino acids in the sequence, is an example of a suitable method for the chemical synthesis of a subject antibody. Various forms of SPPS, such as Fmoc and Boc, are available for synthesizing a subject antibody. Techniques for solid phase synthesis are described by Barany and Merrifield, Solid-Phase Peptide Synthesis; pp. 3-284 in The Peptides: Analysis, Synthesis, Biology. Vol. 2: Special Methods in Peptide Synthesis, Part A., Merrifield, et al. J. Am. Chem. Soc., 85: 2149-2156 (1963); Stewart et al., Solid Phase Peptide Synthesis, 2nd ed. Pierce Chem. Co., Rockford, Ill. (1984); and Ganesan A. 2006 *Mini Rev. Med Chem.* 6:3-10 and Camarero J A et al. 2005 *Protein Pept Lett.* 12:723-8. Briefly, small insoluble, porous beads are treated with functional units on which peptide chains are built. After repeated cycling of coupling/deprotection, the free N-terminal amine of a solid-phase attached is coupled to a single N-protected amino acid unit. This unit is then deprotected, revealing a new N-terminal amine to which a further amino acid may be attached. The peptide remains immobilized on the solid-phase and undergoes a filtration process before being cleaved off.

Standard recombinant methods can be used for production of a subject antibody. For example, nucleic acids encoding light and heavy chain variable regions, optionally linked to constant regions, are inserted into expression vectors. The light and heavy chains can be cloned in the same or different expression vectors. The DNA segments encoding immunoglobulin chains are operably linked to control sequences in the expression vector(s) that ensure the expression of immunoglobulin polypeptides. Expression control sequences include, but are not limited to, promoters (e.g., naturally-associated or heterologous promoters), signal sequences, enhancer elements, and transcription termination sequences. The expression control sequences can be eukaryotic promoter systems in vectors capable of transforming or transfecting eukaryotic host cells (e.g., COS or CHO cells). Once the vector has been incorporated into the appropriate host, the host is maintained under conditions suitable for high level expression of the nucleotide sequences, and the collection and purification of the antibodies.

Because of the degeneracy of the code, a variety of nucleic acid sequences can encode each immunoglobulin amino acid sequence. The desired nucleic acid sequences can be produced by de novo solid-phase DNA synthesis or by polymerase chain reaction (PCR) mutagenesis of an earlier prepared variant of the desired polynucleotide. Oligonucleotide-mediated mutagenesis is an example of a suitable method for preparing substitution, deletion and insertion variants of target polypeptide DNA. See Adelman et al., DNA 2:183 (1983). Briefly, the target polypeptide DNA is altered by hybridizing an oligonucleotide encoding the desired mutation to a single-stranded DNA template. After hybridization, a DNA polymerase is used to synthesize an entire second complementary strand of the template that incorporates the oligonucleotide primer, and encodes the selected alteration in the target polypeptide DNA.

Suitable expression vectors are typically replicable in the host organisms either as episomes or as an integral part of the host chromosomal DNA. Commonly, expression vectors contain selection markers (e.g., ampicillin-resistance, hygromycin-resistance, tetracycline resistance, kanamycin resistance or neomycin resistance) to permit detection of those cells transformed with the desired DNA sequences. *Escherichia coli* is an example of a prokaryotic host cell that can be used for cloning a subject antibody-encoding polynucleotide. Other microbial hosts suitable for use include bacilli, such as *Bacillus subtilis*, and other enterobacteriaceae, such as *Salmonella, Serratia*, and various *Pseudomonas* species. In these prokaryotic hosts, one can also make expression vectors, which will typically contain expression control sequences compatible with the host cell (e.g., an origin of replication). In addition, any number of a variety of well-known promoters will be present, such as the lactose promoter system, a tryptophan (trp) promoter system, a beta-lactamase promoter system, or a promoter system from phage lambda. The promoters will typically control expression, optionally with an operator sequence, and have ribosome binding site sequences and the like, for initiating and completing transcription and translation.

Other microbes, such as yeast, are also useful for expression. *Saccharomyces* (e.g., *S. cerevisiae*) and *Pichia* are examples of suitable yeast host cells, with suitable vectors having expression control sequences (e.g., promoters), an origin of replication, termination sequences and the like as desired. Typical promoters include 3-phosphoglycerate kinase and other glycolytic enzymes. Inducible yeast promoters include, among others, promoters from alcohol dehydrogenase, isocytochrome C, and enzymes responsible for maltose and galactose utilization.

In addition to microorganisms, mammalian cells (e g, mammalian cells grown in in vitro cell culture) can also be used to express and produce the polypeptides of the present invention (e.g., polynucleotides encoding immunoglobulins or fragments thereof). See Winnacker, From Genes to Clones, VCH Publishers, N.Y., N.Y. (1987). Suitable mammalian host cells include CHO cell lines, various Cos cell lines, HeLa cells, myeloma cell lines, and transformed B-cells or hybridomas. Expression vectors for these cells can include expression control sequences, such as an origin of replication, a promoter, and an enhancer (Queen et al., Immunol. Rev. 89:49 (1986)), and necessary processing information sites, such as ribosome binding sites, RNA splice sites, polyadenylation sites, and transcriptional terminator sequences. Examples of suitable expression control sequences are promoters derived from immunoglobulin genes, SV40, adenovirus, bovine papilloma virus, cytomegalovirus and the like. See Co et al., J. Immunol. 148: 1149 (1992).

Once synthesized (either chemically or recombinantly), the whole antibodies, their dimers, individual light and heavy chains, or other forms of a subject antibody (e.g., scFv, etc.) can be purified according to standard procedures of the art, including ammonium sulfate precipitation, affinity columns, column chromatography, high performance liquid chromatography (HPLC) purification, gel electrophoresis, and the like (see generally Scopes, Protein Purification (Springer-Verlag, N.Y., (1982)). A subject antibody can be substantially pure, e.g., at least about 80% to 85% pure, at least about 85% to 90% pure, at least about 90% to 95% pure, or 98% to 99%, or more, pure, e.g., free from contaminants such as cell debris, macromolecules other than a subject antibody, etc.

Compositions

The present disclosure provides a composition comprising a subject antibody. A subject antibody composition can comprise, in addition to a subject antibody, one or more of: a salt, e.g., NaCl, $MgCl_2$, KCl, $MgSO_4$, etc.; a buffering agent, e.g., a Tris buffer, N-(2-Hydroxyethyl)piperazine-N'-(2-ethanesulfonic acid) (HEPES), 2-(N-Morpholino)ethanesulfonic acid (MES), 2-(N-Morpholino)ethanesulfonic acid sodium salt (MES), 3-(N-Morpholino)propanesulfonic acid (MOPS), N-tris[Hydroxymethyl]methyl-3-aminopropanesulfonic acid (TAPS), etc.; a solubilizing agent; a detergent, e.g., a non-ionic detergent such as Tween-20, etc.; a protease inhibitor; glycerol; and the like.

Nucleic Acids

The present disclosure provides nucleic acids comprising nucleotide sequences encoding a subject antibody. A nucleotide sequence encoding a subject antibody can be operably linked to one or more regulatory elements, such as a promoter and enhancer, that allow expression of the nucleotide sequence in the intended target cells (e.g., a cell that is genetically modified to synthesize the encoded antibody).

Suitable promoter and enhancer elements are known in the art. For expression in a bacterial cell, suitable promoters include, but are not limited to, lad, lacZ, T3, T7, gpt, lambda P and trc. For expression in a eukaryotic cell, suitable promoters include, but are not limited to, light and/or heavy chain immunoglobulin gene promoter and enhancer elements; cytomegalovirus immediate early promoter; herpes simplex virus thymidine kinase promoter; early and late SV40 promoters; promoter present in long terminal repeats from a retrovirus; mouse metallothionein-I promoter; and various art-known tissue specific promoters.

In some embodiments, e.g., for expression in a yeast cell, a suitable promoter is a constitutive promoter such as an ADH1 promoter, a PGK1 promoter, an ENO promoter, a PYK1 promoter and the like; or a regulatable promoter such as a GAL1 promoter, a GAL10 promoter, an ADH2 promoter, a PHO5 promoter, a CUP1 promoter, a GAL7 promoter, a MET25 promoter, a MET3 promoter, a CYC1 promoter, a HIS3 promoter, an ADH1 promoter, a PGK promoter, a GAPDH promoter, an ADC1 promoter, a TRP1 promoter, a URA3 promoter, a LEU2 promoter, an ENO promoter, a TP1 promoter, and AOX1 (e.g., for use in Pichia). Selection of the appropriate vector and promoter is well within the level of ordinary skill in the art.

Suitable promoters for use in prokaryotic host cells include, but are not limited to, a bacteriophage T7 RNA polymerase promoter; a trp promoter; a lac operon promoter; a hybrid promoter, e.g., a lac/tac hybrid promoter, a tac/trc hybrid promoter, a trp/lac promoter, a T7/lac promoter; a trc promoter; a tac promoter, and the like; an araBAD promoter; in vivo regulated promoters, such as an ssaG promoter or a related promoter (see, e.g., U.S. Patent Publication No. 20040131637), a pagC promoter (Pulkkinen and Miller, J. Bacteriol., 1991: 173(1): 86-93; Alpuche-Aranda et al., PNAS, 1992; 89(21): 10079-83), a nirB promoter (Harborne et al. (1992) Mol. Micro. 6:2805-2813), and the like (see, e.g., Dunstan et al. (1999) Infect. Immun. 67:5133-5141; McKelvie et al. (2004) Vaccine 22:3243-3255; and Chatfield et al. (1992) Biotechnol. 10:888-892); a sigma70 promoter, e.g., a consensus sigma70 promoter (see, e.g., GenBank Accession Nos. AX798980, AX798961, and AX798183); a stationary phase promoter, e.g., a dps promoter, an spv promoter, and the like; a promoter derived from the pathogenicity island SPI-2 (see, e.g., WO96/17951); an actA promoter (see, e.g., Shetron-Rama et al. (2002) Infect. Immun. 70:1087-1096); an rpsM promoter (see, e.g., Valdivia and Falkow (1996). Mol. Microbiol. 22:367); a tet promoter (see, e.g., Hillen, W. and Wissmann, A. (1989) In Saenger, W. and Heinemann, U. (eds), Topics in Molecular and Structural Biology, Protein—Nucleic Acid Interaction. Macmillan, London, UK, Vol. 10, pp. 143-162); an SP6 promoter (see, e.g., Melton et al. (1984) Nucl. Acids Res. 12:7035); and the like. Suitable strong promoters for use in prokaryotes such as Escherichia coli include, but are not limited to Trc, Tac, T5, T7, and $P_{Lambda}$. Non limiting examples of operators for use in bacterial host cells include a lactose promoter operator (LacI repressor protein changes conformation when contacted with lactose, thereby preventing the LacI repressor protein from binding to the operator), a tryptophan promoter operator (when complexed with tryptophan, TrpR repressor protein has a conformation that binds the operator; in the absence of tryptophan, the TrpR repressor protein has a conformation that does not bind to the operator), and a tac promoter operator (see, for example, deBoer et al. (1983) Proc. Natl. Acad. Sci. U.S.A. 80:21-25).

A nucleotide sequence encoding a subject antibody can be present in an expression vector and/or a cloning vector. Where a subject antibody comprises two separate polypeptides, nucleotide sequences encoding the two polypeptides can be cloned in the same or separate vectors. An expression vector can include a selectable marker, an origin of replication, and other features that provide for replication and/or maintenance of the vector.

Large numbers of suitable vectors and promoters are known to those of skill in the art; many are commercially available for generating a subject recombinant constructs. The following vectors are provided by way of example. Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWLneo, pSV2cat, pOG44, PXR1, pSG (Stratagene) pSVK3, pBPV, pMSG and pSVL (Pharmacia).

Expression vectors generally have convenient restriction sites located near the promoter sequence to provide for the insertion of nucleic acid sequences encoding heterologous proteins. A selectable marker operative in the expression host may be present. Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

As noted above, a subject nucleic acid comprises a nucleotide sequence encoding a subject antibody. A subject nucleic acid can comprise a nucleotide sequence encoding heavy- and light-chain CDRs. In some embodiments, a subject nucleic acid comprises a nucleotide sequence encoding heavy- and light-chain CDRs, where the CDR-encoding sequences are interspersed with FR-encoding nucleotide sequences. In some embodiments, the FR-encoding nucleotide sequences are human FR-encoding nucleotide sequences.

In some embodiments, a subject nucleic acid comprises a nucleotide sequence having at least about 75%, at least about 80%, at least about 85%, at least about 90%, at least about 95%, at least about 98%, at least about 99%, or 100%, nucleotide sequence identity to the nucleotide sequence set forth in herein. In some embodiments, a subject nucleic acid comprises a nucleotide sequence having at least about 75%, at least about 80%, at least about 85%, at least about 90%, at least about 95%, at least about 98%, at least about 99%, or 100%, nucleotide sequence identity to the nucleotide sequence set forth in herein.

Cells

The present disclosure provides isolated genetically modified host cells (e.g., in vitro cells) that are genetically modified with a subject nucleic acid. In some embodiments, a subject isolated genetically modified host cell can produce a subject antibody.

Suitable host cells include eukaryotic host cells, such as a mammalian cell, an insect host cell, a yeast cell; and prokaryotic cells, such as a bacterial cell. Introduction of a subject nucleic acid into the host cell can be effected, for example by calcium phosphate precipitation, DEAE dextran mediated transfection, liposome-mediated transfection, electroporation, or other known method.

Suitable mammalian cells include primary cells and immortalized cell lines. Suitable mammalian cell lines include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, and the like.

Suitable yeast cells include, but are not limited to, *Pichia pastoris, Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa, Chlamydomonas reinhardtii,* and the like.

Suitable prokaryotic cells include, but are not limited to, any of a variety of laboratory strains of *Escherichia coli, Lactobacillus* sp., *Salmonella* sp., *Shigella* sp., and the like. See, e.g., Carrier et al. (1992) J. Immunol. 148:1176-1181; U.S. Pat. No. 6,447,784; and Sizemore et al. (1995) *Science* 270:299-302. Examples of *Salmonella* strains which can be employed in the present invention include, but are not limited to, *Salmonella typhi* and *S. typhimurium*. Suitable *Shigella* strains include, but are not limited to, *Shigella flexneri, Shigella sonnei,* and *Shigella* disenteriae. Typically, the laboratory strain is one that is non-pathogenic. Non-limiting examples of other suitable bacteria include, but are not limited to, *Bacillus subtilis, Pseudomonas pudita, Pseudomonas aeruginosa, Pseudomonas* mevalonii, *Rhodobacter sphaeroides, Rhodobacter capsulatus, Rhodospirillum rubrum, Rhodococcus* sp., and the like. In some embodiments, the host cell is *Escherichia coli*.

Compositions

The present disclosure provides compositions, including pharmaceutical compositions, comprising a subject antibody. In general, a formulation comprises an effective amount of a subject antibody. An "effective amount" means a dosage sufficient to produce a desired result, e.g., an increase of muscle mass or amelioration of a symptom of a disease. Generally, the desired result is at least a reduction in a symptom of an ACVR2A-associated conditino, as compared to a control. A subject antibody can be delivered in such a manner as to avoid the blood-brain barrier, as described in more detail below. A subject antibody can be formulated and/or modified to enable the antibody to cross the blood-brain barrier.

Formulations

In the subject methods, a subject antibody can be administered to the host using any convenient means capable of resulting in the desired therapeutic effect or diagnostic effect. Thus, the agent can be incorporated into a variety of formulations for therapeutic administration. More particularly, a subject antibody can be formulated into pharmaceutical compositions by combination with appropriate, pharmaceutically acceptable carriers or diluents, and may be formulated into preparations in solid, semi-solid, liquid or gaseous forms, such as tablets, capsules, powders, granules, ointments, solutions, suppositories, injections, inhalants and aerosols.

In pharmaceutical dosage forms, a subject antibody can be administered in the form of their pharmaceutically acceptable salts, or they may also be used alone or in appropriate association, as well as in combination, with other pharmaceutically active compounds. The following methods and excipients are merely exemplary and are in no way limiting.

For oral preparations, a subject antibody can be used alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives and flavoring agents.

A subject antibody can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

Pharmaceutical compositions comprising a subject antibody are prepared by mixing the antibody having the desired degree of purity with optional physiologically acceptable carriers, excipients, stabilizers, surfactants, buffers and/or tonicity agents. Acceptable carriers, excipients and/or stabilizers are nontoxic to recipients at the dosages and concentrations employed, and include buffers such as phosphate, citrate, and other organic acids; antioxidants including ascorbic acid, glutathione, cysteine, methionine and citric acid; preservatives (such as ethanol, benzyl alcohol, phenol, m-cresol, p-chlor-m-cresol, methyl or propyl parabens, benzalkonium chloride, or combinations thereof); amino acids such as arginine, glycine, ornithine, lysine, histidine, glutamic acid, aspartic acid, isoleucine, leucine, alanine, phenylalanine, tyrosine, tryptophan, methionine, serine, proline and combinations thereof; monosaccharides, disaccharides and other carbohydrates; low molecular weight (less than about 10 residues) polypeptides; proteins, such as gelatin or serum albumin; chelating agents such as EDTA; sugars such as trehalose, sucrose, lactose, glucose, mannose, maltose, galactose, fructose, sorbose, raffinose, glucosamine, N-methylglucosamine, galactosamine, and neuraminic acid; and/or non-ionic surfactants such as Tween, Brij Pluronics, Triton-X, or polyethylene glycol (PEG).

The pharmaceutical composition may be in a liquid form, a lyophilized form or a liquid form reconstituted from a lyophilized form, wherein the lyophilized preparation is to be reconstituted with a sterile solution prior to administration. The standard procedure for reconstituting a lyophilized composition is to add back a volume of pure water (typically equivalent to the volume removed during lyophilization); however solutions comprising antibacterial agents may be used for the production of pharmaceutical compositions for parenteral administration; see also Chen (1992) Drug Dev Ind Pharm 18, 1311-54.

Exemplary antibody concentrations in a subject pharmaceutical composition may range from about 1 mg/mL to about 200 mg/ml or from about 50 mg/mL to about 200 mg/mL, or from about 150 mg/mL to about 200 mg/mL.

An aqueous formulation of the antibody may be prepared in a pH-buffered solution, e.g., at pH ranging from about 4.0 to about 7.0, or from about 5.0 to about 6.0, or alternatively about 5.5. Examples of buffers that are suitable for a pH within this range include phosphate-, histidine-, citrate-, succinate-, acetate-buffers and other organic acid buffers. The buffer concentration can be from about 1 mM to about 100 mM, or from about 5 mM to about 50 mM, depending, e.g., on the buffer and the desired tonicity of the formulation.

A tonicity agent may be included in the antibody formulation to modulate the tonicity of the formulation. Exemplary tonicity agents include sodium chloride, potassium chloride, glycerin and any component from the group of amino acids, sugars as well as combinations thereof. In some embodiments, the aqueous formulation is isotonic, although hypertonic or hypotonic solutions may be suitable. The term "isotonic" denotes a solution having the same tonicity as some other solution with which it is compared, such as physiological salt solution or serum. Tonicity agents may be used in an amount of about 5 mM to about 350 mM, e.g., in an amount of 100 mM to 350 nM.

A surfactant may also be added to the antibody formulation to reduce aggregation of the formulated antibody and/or minimize the formation of particulates in the formulation and/or reduce adsorption. Exemplary surfactants include polyoxyethylensorbitan fatty acid esters (Tween), polyoxyethylene alkyl ethers (Brij), alkylphenylpolyoxyethylene ethers (Triton-X), polyoxyethylene-polyoxypropylene copolymer (Poloxamer, Pluronic), and sodium dodecyl sulfate (SDS). Examples of suitable polyoxyethylenesorbitan-fatty acid esters are polysorbate 20, (sold under the trademark Tween 20™) and polysorbate 80 (sold under the trademark Tween 80™). Examples of suitable polyethylene-polypropylene copolymers are those sold under the names Pluronic® F68 or Poloxamer 188™. Examples of suitable Polyoxyethylene alkyl ethers are those sold under the trademark Brij™. Exemplary concentrations of surfactant may range from about 0.001% to about 1% w/v.

A lyoprotectant may also be added in order to protect the labile active ingredient (e.g. a protein) against destabilizing conditions during the lyophilization process. For example, known lyoprotectants include sugars (including glucose and sucrose); polyols (including mannitol, sorbitol and glycerol); and amino acids (including alanine, glycine and glutamic acid). Lyoprotectants can be included in an amount of about 10 mM to 500 nM.

In some embodiments, a subject formulation includes a subject antibody, and one or more of the above-identified agents (e.g., a surfactant, a buffer, a stabilizer, a tonicity agent) and is essentially free of one or more preservatives, such as ethanol, benzyl alcohol, phenol, m-cresol, p-chlorm-cresol, methyl or propyl parabens, benzalkonium chloride, and combinations thereof. In other embodiments, a preservative is included in the formulation, e.g., at concentrations ranging from about 0.001 to about 2% (w/v).

For example, a subject formulation can be a liquid or lyophilized formulation suitable for parenteral administration, and can comprise: about 1 mg/mL to about 200 mg/mL of a subject antibody; about 0.001% to about 1% of at least one surfactant; about 1 mM to about 100 mM of a buffer; optionally about 10 mM to about 500 mM of a stabilizer; and about 5 mM to about 305 mM of a tonicity agent; and has a pH of about 4.0 to about 7.0.

As another example, a subject parenteral formulation is a liquid or lyophilized formulation comprising: about 1 mg/mL to about 200 mg/mL of a subject antibody; 0.04% Tween 20 w/v; 20 mM L-histidine; and 250 mM Sucrose; and has a pH of 5.5.

As another example, a subject parenteral formulation comprises a lyophilized formulation comprising: 1) 15 mg/mL of a subject antibody; 0.04% Tween 20 w/v; 20 mM L-histidine; and 250 mM sucrose; and has a pH of 5.5; or 2) 75 mg/mL of a subject antibody; 0.04% Tween 20 w/v; 20 mM L-histidine; and 250 mM sucrose; and has a pH of 5.5; or 3) 75 mg/mL of a subject antibody; 0.02% Tween 20 w/v; 20 mM L-histidine; and 250 mM Sucrose; and has a pH of 5.5; or 4) 75 mg/mL of a subject antibody; 0.04% Tween 20 w/v; 20 mM L-histidine; and 250 mM trehalose; and has a pH of 5.5; or 6) 75 mg/mL of a subject antibody; 0.02% Tween 20 w/v; 20 mM L-histidine; and 250 mM trehalose; and has a pH of 5.5.

As another example, a subject parenteral formulation is a liquid formulation comprising: 1) 7.5 mg/mL of a subject antibody; 0.022% Tween 20 w/v; 120 mM L-histidine; and 250 125 mM sucrose; and has a pH of 5.5; or 2) 37.5 mg/mL of a subject antibody; 0.02% Tween 20 w/v; 10 mM L-histidine; and 125 mM sucrose; and has a pH of 5.5; or 3) 37.5 mg/mL of a subject antibody; 0.01% Tween 20 w/v; 10 mM L-histidine; and 125 mM sucrose; and has a pH of 5.5; or 4) 37.5 mg/mL of a subject antibody; 0.02% Tween 20 w/v; 10 mM L-histidine; 125 mM trehalose; and has a pH of 5.5; or 5) 37.5 mg/mL of a subject antibody; 0.01% Tween 20 w/v; 10 mM L-histidine; and 125 mM trehalose; and has a pH of 5.5; or 6) 5 mg/mL of a subject antibody; 0.02% Tween 20 w/v; 20 mM L-histidine; and 250 mM trehalose; and has a pH of 5.5; or 7) 75 mg/mL of a subject antibody; 0.02% Tween 20 w/v; 20 mM L-histidine; and 250 mM mannitol; and has a pH of 5.5; or 8) 75 mg/mL of a subject antibody; 0.02% Tween 20 w/v; 20 mM L histidine; and 140 mM sodium chloride; and has a pH of 5.5; or 9) 150 mg/mL of a subject antibody; 0.02% Tween 20 w/v; 20 mM L-histidine; and 250 mM trehalose; and has a pH of 5.5; or 10) 150 mg/mL of a subject antibody; 0.02% Tween 20 w/v; 20 mM L-histidine; and 250 mM mannitol; and has a pH of 5.5; or 11) 150 mg/mL of a subject antibody; 0.02% Tween 20 w/v; 20 mM L-histidine; and 140 mM sodium chloride; and has a pH of 5.5; or 12) 10 mg/mL of a subject antibody; 0.01% Tween 20 w/v; 20 mM L-histidine; and 40 mM sodium chloride; and has a pH of 5.5.

A subject antibody can be utilized in aerosol formulation to be administered via inhalation. A subject antibody can be formulated into pressurized acceptable propellants such as dichlorodifluoromethane, propane, nitrogen and the like.

Furthermore, a subject antibody can be made into suppositories by mixing with a variety of bases such as emulsifying bases or water-soluble bases. A subject antibody can be administered rectally via a suppository. The suppository can include vehicles such as cocoa butter, carbowaxes and polyethylene glycols, which melt at body temperature, yet are solidified at room temperature.

Unit dosage forms for oral or rectal administration such as syrups, elixirs, and suspensions may be provided wherein each dosage unit, for example, teaspoonful, tablespoonful, tablet or suppository, contains a predetermined amount of the composition containing one or more inhibitors. Similarly, unit dosage forms for injection or intravenous administration may comprise a subject antibody in a composition as a solution in sterile water, normal saline or another pharmaceutically acceptable carrier.

The term "unit dosage form," as used herein, refers to physically discrete units suitable as unitary dosages for human and animal subjects, each unit containing a predetermined quantity of compounds of the present invention calculated in an amount sufficient to produce the desired effect in association with a pharmaceutically acceptable diluent, carrier or vehicle. The specifications for a subject antibody may depend on the particular antibody employed and the effect to be achieved, and the pharmacodynamics associated with each antibody in the host.

Other modes of administration will also find use with the subject invention. For instance, a subject antibody can be formulated in suppositories and, in some cases, aerosol and intranasal compositions. For suppositories, the vehicle composition will include traditional binders and carriers such as, polyalkylene glycols, or triglycerides. Such suppositories may be formed from mixtures containing the active ingredient in the range of about 0.5% to about 10% (w/w), e.g., about 1% to about 2%.

Intranasal formulations will usually include vehicles that neither cause irritation to the nasal mucosa nor significantly disturb ciliary function. Diluents such as water, aqueous saline or other known substances can be employed with the subject invention. The nasal formulations may also contain preservatives such as, but not limited to, chlorobutanol and benzalkonium chloride. A surfactant may be present to enhance absorption of the subject proteins by the nasal mucosa.

A subject antibody can be administered as an injectable formulation. Typically, injectable compositions are prepared as liquid solutions or suspensions; solid forms suitable for solution in, or suspension in, liquid vehicles prior to injection may also be prepared. The preparation may also be emulsified or the antibody encapsulated in liposome vehicles.

Suitable excipient vehicles are, for example, water, saline, dextrose, glycerol, ethanol, or the like, and combinations thereof. In addition, if desired, the vehicle may contain minor amounts of auxiliary substances such as wetting or emulsifying agents or pH buffering agents. Actual methods of preparing such dosage forms are known, or will be apparent, to those skilled in the art. See, e.g., Remington's Pharmaceutical Sciences, Mack Publishing Company, Easton, Pa., 17th edition, 1985. The composition or formulation to be administered will, in any event, contain a quantity of a subject antibody adequate to achieve the desired state in the subject being treated.

The pharmaceutically acceptable excipients, such as vehicles, adjuvants, carriers or diluents, are readily available to the public. Moreover, pharmaceutically acceptable auxiliary substances, such as pH adjusting and buffering agents, tonicity adjusting agents, stabilizers, wetting agents and the like, are readily available to the public.

In some embodiments, a subject antibody is formulated in a controlled release formulation. Sustained-release preparations may be prepared using methods well known in the art. Suitable examples of sustained-release preparations include semipermeable matrices of solid hydrophobic polymers containing the antibody in which the matrices are in the form of shaped articles, e.g. films or microcapsules. Examples of sustained-release matrices include polyesters, copolymers of L-glutamic acid and ethyl-L-glutamate, non-degradable ethylene-vinyl acetate, hydrogels, polylactides, degradable lactic acid-glycolic acid copolymers and poly-D-(−)-3-hydroxybutyric acid. Possible loss of biological activity and possible changes in immunogenicity of antibodies comprised in sustained-release preparations may be prevented by using appropriate additives, by controlling moisture content and by developing specific polymer matrix compositions.

Controlled release within the scope of this invention can be taken to mean any one of a number of extended release dosage forms. The following terms may be considered to be substantially equivalent to controlled release, for the purposes of the present invention: continuous release, controlled release, delayed release, depot, gradual release, long-term release, programmed release, prolonged release, proportionate release, protracted release, repository, retard, slow release, spaced release, sustained release, time coat, timed release, delayed action, extended action, layered-time action, long acting, prolonged action, repeated action, slowing acting, sustained action, sustained-action medications, and extended release. Further discussions of these terms may be found in Lesczek Krowczynski, *Extended-Release Dosage Forms*, 1987 (CRC Press, Inc.).

The various controlled release technologies cover a very broad spectrum of drug dosage forms. Controlled release technologies include, but are not limited to physical systems and chemical systems.

Physical systems include, but are not limited to, reservoir systems with rate-controlling membranes, such as microencapsulation, macroencapsulation, and membrane systems; reservoir systems without rate-controlling membranes, such as hollow fibers, ultra microporous cellulose triacetate, and porous polymeric substrates and foams; monolithic systems, including those systems physically dissolved in non-porous, polymeric, or elastomeric matrices (e.g., nonerodible, erodible, environmental agent ingression, and degradable), and materials physically dispersed in non-porous, polymeric, or elastomeric matrices (e.g., nonerodible, erodible, environmental agent ingression, and degradable); laminated structures, including reservoir layers chemically similar or dissimilar to outer control layers; and other physical methods, such as osmotic pumps, or adsorption onto ion-exchange resins.

Chemical systems include, but are not limited to, chemical erosion of polymer matrices (e.g., heterogeneous, or homogeneous erosion), or biological erosion of a polymer matrix (e.g., heterogeneous, or homogeneous). Additional discussion of categories of systems for controlled release may be found in Agis F. Kydonieus, *Controlled Release Technologies: Methods, Theory and Applications*, 1980 (CRC Press, Inc.).

There are a number of controlled release drug formulations that are developed for oral administration. These include, but are not limited to, osmotic pressure-controlled gastrointestinal delivery systems; hydrodynamic pressure-controlled gastrointestinal delivery systems; membrane permeation-controlled gastrointestinal delivery systems, which include microporous membrane permeation-controlled gastrointestinal delivery devices; gastric fluid-resistant intestine targeted controlled-release gastrointestinal delivery devices; gel diffusion-controlled gastrointestinal delivery systems; and ion-exchange-controlled gastrointestinal delivery systems, which include cationic and anionic drugs. Additional information regarding controlled release drug delivery systems may be found in Yie W. Chien, *Novel Drug Delivery Systems*, 1992 (Marcel Dekker, Inc.).

Dosages

A suitable dosage can be determined by an attending physician or other qualified medical personnel, based on various clinical factors. As is well known in the medical arts, dosages for any one patient depend upon many factors, including the patient's size, body surface area, age, the particular compound to be administered, sex of the patient, time, and route of administration, general health, and other drugs being administered concurrently. A subject antibody may be administered in amounts between 1 ng/kg body weight and 20 mg/kg body weight per dose, e.g. between 0.1 mg/kg body weight to 10 mg/kg body weight, e.g. between 0.5 mg/kg body weight to 5 mg/kg body weight; however, doses below or above this exemplary range are envisioned, especially considering the aforementioned factors. If the regimen is a continuous infusion, it can also be in the range of 1 µg to 10 mg per kilogram of body weight per minute.

Those of skill will readily appreciate that dose levels can vary as a function of the specific antibody, the severity of the symptoms and the susceptibility of the subject to side effects. Preferred dosages for a given compound are readily determinable by those of skill in the art by a variety of means.

Routes of Administration

A subject antibody is administered to an individual using any available method and route suitable for drug delivery, including in vivo and ex vivo methods, as well as systemic and localized routes of administration.

Conventional and pharmaceutically acceptable routes of administration include intranasal, intramuscular, intratracheal, subcutaneous, intradermal, topical application, intravenous, intraarterial, rectal, nasal, oral, and other enteral and parenteral routes of administration. Routes of administration may be combined, if desired, or adjusted depending upon the antibody and/or the desired effect. A subject antibody composition can be administered in a single dose or in multiple doses. In some embodiments, a subject antibody composition is administered orally. In some embodiments, a subject antibody composition is administered via an inhalational route. In some embodiments, a subject antibody composition is administered intranasally. In some embodiments, a subject antibody composition is administered locally. In some embodiments, a subject antibody composition is administered intracranially. In some embodiments, a subject antibody composition is administered intravenously.

The agent can be administered to a host using any available conventional methods and routes suitable for delivery of conventional drugs, including systemic or localized routes. In general, routes of administration contemplated by the invention include, but are not necessarily limited to, enteral, parenteral, or inhalational routes.

Parenteral routes of administration other than inhalation administration include, but are not necessarily limited to, topical, transdermal, subcutaneous, intramuscular, intraorbital, intracapsular, intraspinal, intrasternal, and intravenous routes, i.e., any route of administration other than through the alimentary canal. Parenteral administration can be carried to effect systemic or local delivery of a subject antibody. Where systemic delivery is desired, administration typically involves invasive or systemically absorbed topical or mucosal administration of pharmaceutical preparations.

A subject antibody can also be delivered to the subject by enteral administration. Enteral routes of administration include, but are not necessarily limited to, oral and rectal (e.g., using a suppository) delivery.

By treatment is meant at least an amelioration of the symptoms associated with the pathological condition afflicting the host, where amelioration is used in a broad sense to refer to at least a reduction in the magnitude of a parameter, e.g. symptom, associated with the pathological condition being treated, such as muscle atrophy. As such, treatment also includes situations where the pathological condition, or at least symptoms associated therewith, are completely inhibited, e.g. prevented from happening, or stopped, e.g. terminated, such that the host no longer suffers from the pathological condition, or at least the symptoms that characterize the pathological condition.

In some embodiments, a subject antibody is administered by injection and/or delivery, e.g., to a site in a brain artery or directly into brain tissue. A subject antibody can also be administered directly to a target site e.g., by biolistic delivery to the target site.

A variety of hosts (wherein the term "host" is used interchangeably herein with the terms "subject," "individual," and "patient") are treatable according to the subject methods. Generally such hosts are "mammals" or "mammalian," where these terms are used broadly to describe organisms which are within the class mammalia, including the orders carnivore (e.g., dogs and cats), rodentia (e.g., mice, guinea pigs, and rats), and primates (e.g., humans, chimpanzees, and monkeys). In some embodiments, the hosts will be humans.

Kits with unit doses of a subject antibody, e.g. in oral or injectable doses, are provided. In such kits, in addition to the containers containing the unit doses will be an informational package insert describing the use and attendant benefits of the antibody in treating pathological condition of interest. Preferred compounds and unit doses are those described herein above.

Treatment Methods

The present disclosure provides methods of treating an ACVR2A-associated condition, the methods generally involving administering to an individual in need thereof (e.g., an individual having a ACVR2A-associated condition) an effective amount of a subject antibody, alone (e.g., in monotherapy) or in combination (e.g., in combination therapy) with one or more additional therapeutic agents. In certain embodiments, an ACVR2A-specific antibody can be used for treating or preventing a disease or condition that can be treated by decreasing ACVR2A signaling. In certain embodiments, the present invention provides methods of treating or preventing a disease, disorder, or condition in an individual in need thereof through administering to the individual a therapeutically effective amount of an ACVR2A-specific antibody as described above. These methods are particularly aimed at therapeutic and prophylactic treatments of animals, and more particularly, humans.

Mice genetically deficient in the inhibin-α subunit are deficient in inhibin A and inhibin B, have gonadal tumors that overexpress activins A and B (Matzuk et al., 1992, Nature 360:313-319; Matzuk et al., 1994, Proc Natl Acad Sci USA 91:8817-8821). All such mice develop these tumors and eventually die of a cancer cachexia-like syndrome mediated by high levels of tumor-derived activin acting through ACVR2A (Coerver et al., 1996, Mol Endocrinol 10:534-543). While not wishing to limit the present invention, an antibody that specifically blocks binding of a ligand to ACVR2A may be useful for treating a variety of conditions that are related to muscle atrophy. For example, an ACVR2A-specific antibody may be used to reduce the effects of activin-producing tumors, alleviating activin-mediated cachexia, and prolonging patient survival. In some embodiments, the subject may have a muscle-wasting disorder such as insufficient lean body mass, a decrease in muscle mass or muscle function, cachexia or sarcopenia.

ACVR2A and ACVR2A-ligand complexes play essential roles in tissue growth as well as early developmental processes such as the correct formation of various structures or in one or more post-developmental capacities including sexual development, pituitary hormone production, and creation of bone and cartilage. Thus, ACVR2A-associated conditions include abnormal tissue growth and developmental defects. In addition, ACVR2A-associated conditions include, but are not limited to, disorders of cell growth and differentiation such as inflammation, allergy, autoimmune diseases, infectious diseases, and tumors.

Exemplary ACVR2A-associated conditions include neuromuscular disorders (e.g., muscular dystrophy and muscle atrophy), congestive obstructive pulmonary disease or pulmonary emphysema (and associated muscle wasting), muscle wasting syndrome, sarcopenia, cachexia, adipose tissue disorders (e.g., obesity), type 2 diabetes, and bone degenerative disease (e.g., osteoporosis). Other exemplary ACVR2A-associated conditions include musculodegenerative and neuromuscular disorders, tissue repair (e.g., wound healing), neurodegenerative diseases (e.g., amyotrophic lateral sclerosis), immunologic disorders (e.g., disorders related to abnormal proliferation or function of lymphocytes), and obesity or disorders related to abnormal proliferation of adipocytes.

In certain embodiments, an ACVR2A-specific antibody may be used as part of a treatment for a muscular dystrophy. The term "muscular dystrophy" refers to a group of degenerative muscle diseases characterized by gradual weakening and deterioration of skeletal muscles and sometimes the heart and respiratory muscles. Muscular dystrophies are genetic disorders characterized by progressive muscle wasting and weakness that begin with microscopic changes in the muscle. As muscles degenerate over time, the person's muscle strength declines. Exemplary muscular dystrophies that can be treated with a regimen including the subject ACVR2A-specific antibodies include: Duchenne muscular dystrophy (DMD), Becker muscular dystrophy (BMD), Emery-Dreifuss muscular dystrophy (EDMD), limb-girdle muscular dystrophy (LGMD), fascioscapulohumeral muscular dystrophy (FSH or FSHD) (also known as Landouzy-Dejerine), myotonic muscular dystrophy (MMD) (also known as Steinert's Disease), oculopharyngeal muscular dystrophy (OPMD), distal muscular dystrophy (DD), congenital muscular dystrophy (CMD), and scapulohumeral muscular dystrophy (SMD).

Duchenne muscular dystrophy (DMD) was first described by the French neurologist Guillaume Benjamin Amand Duchenne in the 1860s. Becker muscular dystrophy (BMD) is named after the German doctor Peter Emil Becker, who first described this variant of DMD in the 1950s. DMD is one of the most frequent inherited diseases in males, affecting one in 3,500 boys. DMD occurs when the dystrophin gene, located on the short arm of the X chromosome, is broken. Since males only carry one copy of the X chromosome, they only have one copy of the dystrophin gene. Without the dystrophin protein, muscle is easily damaged during cycles of contraction and relaxation. While early in the disease muscle compensates by regeneration, later on muscle progenitor cells cannot keep up with the ongoing damage and healthy muscle is replaced by non-functional fibro-fatty tissue.

In other embodiments, ACVR2A-specific antibodies may also be used to treat or prevent muscular atrophy due to myopathies, examples of which include inflammatory myopathy, metabolic myopathy, and myotonia. Subject ACVR2A-specific antibodies have application in treating congenital myopathies such as myotubular myopathy, nemalene myopathy, and mitochondrial myopathy. The subject ACVR2A-specific antibodies may be used to treat inclusion body myositis, myoglobinurias, rhabdomyolysis, myositis ossificans, polymyositis, or dermatomyositis. In addition, ACVR2A-specific antibodies may treat or prevent muscle atrophy arising from glucocorticoid treatment, sarcopenia, prolonged bed rest, skeletal immobilization, sepsis, or congestive heart failure.

An ACVR2A-specific antibody may provide an effective means to increase muscle mass in other neuromuscular diseases or conditions that are in need of muscle growth. For example, amyotrophic lateral sclerosis (ALS, also known as Lou Gehrig's disease or motor neuron disease) is a chronic, incurable, and unstoppable CNS disorder that attacks the motor neurons, components of the CNS that connect the brain to the skeletal muscles. In ALS, the motor neurons deteriorate and eventually die, and though a person's brain normally remains fully functioning and alert, the command to move cannot reach the muscles, Most people who develop ALS are between 40 and 70 years old. The first motor neurons that weaken are those leading to the arms or legs. Those with ALS may have trouble walking, they may drop things, fall, slur their speech, and laugh or cry uncontrollably. Eventually the muscles in the limbs begin to atrophy from disuse. This muscle weakness will become debilitating and a person will need a wheel chair or become unable to function out of bed. Most ALS patients die from respiratory failure or from complications of ventilator assistance like pneumonia, 3-5 years from disease onset. Other neuromuscular diseases in which ACVR2A-specific antibodies may be useful include paralysis due to spinal cord injury or stroke; denervation due to trauma or degenerative, metabolic, or inflammatory neuropathy; adult motor neuron disease; autoimmune motor neuropathy with multifocal conductor block; and infantile or juvenile spinal muscular atrophy.

Increased muscle mass induced by ACVR2A-specific antibodies might also benefit those suffering from muscle wasting diseases. Gonzalez-Cadavid et al (1998, Proc. Natl. Acad. Sci. USA 95:14938-43) reported that that GDF8 expression correlates inversely with fat-free mass in humans and that increased expression of the GDF8 gene is associated with weight loss in men with AIDS wasting syndrome. By inhibiting the function of GDF8 in AIDS patients, at least certain symptoms of AIDS may be alleviated, if not completely eliminated, thus significantly improving quality of life in AIDS patients.

The cancer anorexia-cachexia syndrome is among the most debilitating and life-threatening aspects of cancer. Progressive weight loss in cancer anorexia-cachexia syndrome is a common feature of many types of cancer and is responsible not only for a poor quality of life and poor response to chemotherapy, but also a shorter survival time than is found in patients with comparable tumors without weight loss. Associated with anorexia, fat and muscle tissue wasting, psychological distress, and a lower quality of life, cachexia arises from a complex interaction between the cancer and the host. It is one of the most common causes of death among cancer patients and is present in 80% at death. It is a complex example of metabolic chaos effecting protein, carbohydrate, and fat metabolism. Tumors produce both direct and indirect abnormalities, resulting in anorexia and weight loss. Currently, there is no treatment to control or reverse the process. Cancer anorexia-cachexia syndrome affects cytokine production, release of lipid-mobilizing and proteolysis-inducing factors, and alterations in intermediary metabolism. Although anorexia is common, a decreased food intake alone is unable to account for the changes in body composition seen in cancer patients, and increasing nutrient intake is unable to reverse the wasting syndrome. Cachexia is generally suspected in patients with cancer if an involuntary weight loss of greater than five percent of premorbid weight occurs within a six-month period.

Since systemic overexpression of GDF8 in adult mice was found to induce profound muscle and fat loss analogous to that seen in human cachexia syndromes (Zimmers et al., 2002, Science 296:1486-1488), the subject ACVR2A-specific antibodies can be, beneficially used to prevent, treat, or alleviate the symptoms of the cachexia syndrome, where muscle growth is desired. This would include cachexia associated with cancer as well as cachexia associated with rheumatoid arthritis.

Combination Therapy

In some embodiments, a subject treatment method involves administering a subject antibody and one or more additional therapeutic agents. Suitable additional therapeutic agents include, but are not limited to, anabolic steroids, deacetylase inhibitors and selective adrenergic receptor modulators (SARMs).

Subjects Suitable for Treatment

A variety of subjects are suitable for treatment with a subject method. Suitable subjects include any individual, e.g., a human, who has an ACVR2A-associated condition, who has been diagnosed with an ACVR2A-associated condition, who is at risk for developing an ACVR2A-associated condition, who has had an ACVR2A-associated condition and is at risk for recurrence of the an ACVR2A-associated condition, or who is recovering from an an ACVR2A-associated condition.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1

Phage Display Screening

Phagemid expression of diversified monovalent Fab libraries was accomplished by standard methods. TG-1 cells transformed with expression plasmids were grown to mid log (O.D. 600.about.0.3) in 2-YT media supplemented with 100 mcg/ml ampicillin and 2% glucose repression and then infected with m13K07 helper phage and grown overnight in 2-YT media supplemented with 100 mcg ampicillin, 70 mcg/ml kanamycin, and 200 micromolar IPTG. Phage containing supernatants were precipitated using polyethylene glycol and PBS resuspended phage were used to pan on immobilized ACVR2.

Panning of the libraries was performed by using recombinant soluble extracellular domains of ACVR2 (Peprotech or R&D Systems) immobilized on the wells of a microtiter dish or biotinylated ACVR2 immobilized on streptavidin derivatized magnetic beads (Dynal—Life Technologies).

To identify phage clones that encoded ACVR2-binding monovalent Fabs, a portion of the eluted phage were used to infect E. coli HB2151 allowing expression of periplasmic phage-encoded monovalent Fabs. Individual clones were picked into deep-well plates and grown overnight in 2 YT containing ampicillin and 0.2 mM IPTG. Bacteria were lysed in BPERII and the lysates were applied to ACVR2 coated plates. Following washing, binding of antibodies was detected using an HRP-conjugated anti-human kappa and lambda light chain antibody (Bethyl). Daughter plates were also inoculated and grown in 2 YT-Amp-glucose for Sanger-based sequencing to determine the antibody heavy and light chain sequences.

Example 2

Initial ELISA Assays

The binding of ACVR2A-specific monoclonal antibodies to human ACVR2A, mouse ACVR2A, biotinylated goat anti-human kappa light chain (positive control) and human Fc (negative control) were determined by ELISA.

The results of this assay are shown in Table 4 below. The values shown are optical densities. The data in this table shows that the antibodies listed I specifically bind to ACVR2A. The sequences of the heavy and light chains of the antibodies listed in Table 4 are shown above in FIGS. 2A-2F.

TABLE 4

| Ab | Human ACVR2A | Mouse ACVR2A | Goat anti-Human Kappa | Human Fc |
|---|---|---|---|---|
| 365_B04 | 1.993 | 2.179 | 3.121 | 0.271 |
| 365_B10 | 2.819 | 2.782 | 3.212 | 0.322 |
| 365_C03 | 2.257 | 2.648 | 3.499 | 0.332 |
| 365_C06 | 1.785 | 2.229 | 3.447 | 0.318 |
| 365_D04 | 2.269 | 2.389 | 3.517 | 0.316 |
| 365_E04 | 2.342 | 2.401 | 3.54 | 0.46 |
| 365_F11 | 2.01 | 2.141 | 3.502 | 0.302 |
| 365_G07 | 2.424 | 2.596 | 3.467 | 0.331 |
| 365_H08 | 2.674 | 2.607 | 3.589 | 0.488 |
| 366_A02 | 2.448 | 2.687 | 3.583 | 0.336 |
| 366_A04 | 1.823 | 1.988 | 3.397 | 0.319 |
| 366_D01 | 2.361 | 2.46 | 3.484 | 0.374 |
| 366_D03 | 2.233 | 2.375 | 3.475 | 0.318 |
| 366_F10 | 2.048 | 2.211 | 3.518 | 0.28 |
| 366_G06 | 2.676 | 2.818 | 3.407 | 0.341 |
| 367_B09 | 2.422 | 2.429 | 3.365 | 0.476 |
| 367_B11 | 2.34 | 2.463 | 3.598 | 0.37 |
| 367_C09 | 2.413 | 2.771 | 3.445 | 0.263 |
| 367_D11 | 2.395 | 2.54 | 3.39 | 0.304 |
| 367_F06 | 2.008 | 2.045 | 3.345 | 0.265 |
| 367_H01 | 2.817 | 2.695 | 3.654 | 0.388 |
| 368_A02 | 2.573 | 2.741 | 3.691 | 0.376 |
| 368_A06 | 2.249 | 2.515 | 3.282 | 0.483 |
| 368_A12 | 3.009 | 2.781 | 3.693 | 0.425 |
| 368_B03 | 2.045 | 2.045 | 3.377 | 0.297 |
| 368_B08 | 1.979 | 2.182 | 3.208 | 0.314 |
| 368_B10 | 2.349 | 2.417 | 3.024 | 0.412 |
| 368_B11 | 2.14 | 2.35 | 3.607 | 0.286 |
| 368_C09 | 2.478 | 2.611 | 3.461 | 0.341 |
| 368_D09 | 2.194 | 2.11 | 3.461 | 0.212 |
| 368_F02 | 2.184 | 2.272 | 3.653 | 0.317 |
| 368_F10 | 2.254 | 2.602 | 3.522 | 0.328 |
| 369_B03 | 3.321 | 3.314 | 3.521 | 0.62 |
| 369_G10 | 3.37 | 3.295 | 3.491 | 0.423 |
| 369_H03 | 2.829 | 3.085 | 3.469 | 0.498 |

TABLE 4-continued

| Ab | Human ACVR2A | Mouse ACVR2A | Goat anti-Human Kappa | Human Fc |
|---|---|---|---|---|
| 370_B01 | 3.375 | 3.473 | 3.752 | 0.47 |
| 370_D06 | 2.257 | 2.658 | 3.483 | 0.334 |
| 370_G04 | 1.825 | 2.125 | 3.513 | 0.423 |
| 370_H08 | 2.937 | 3.24 | 3.647 | 0.538 |
| 371_A04 | 1.008 | 1.173 | 3.532 | 0.315 |
| 371_A09 | 1.855 | 1.998 | 3.617 | 0.302 |
| 371_D07 | 2.661 | 2.902 | 3.59 | 0.299 |
| 371_D12 | 1.89 | 1.999 | 3.435 | 0.337 |
| 371_H02 | 1.881 | 2.026 | 3.623 | 0.388 |
| 372_A09 | 2.433 | 2.56 | 3.498 | 0.31 |
| 372_B11 | 2.309 | 2.575 | 3.73 | 0.438 |
| 372_E02 | 2.841 | 2.743 | 3.581 | 0.431 |
| 373_E11 | 3.301 | 3.361 | 3.172 | 0.243 |
| 373_H02 | 3.245 | 3.257 | 3.239 | 0.287 |
| 374_B02 | 3.421 | 3.537 | 3.024 | 0.179 |
| 374_F03 | 3.532 | 3.617 | 3.233 | 0.185 |
| 375_A04 | 3.72 | 3.734 | 3.101 | 0.177 |
| 375_A11 | 3.729 | 3.696 | 3.047 | 0.176 |
| 375_C10 | 3.459 | 3.596 | 3.333 | 0.294 |
| 375_F12 | 2.951 | 3.143 | 3.17 | 0.175 |
| 375_H01 | 2.787 | 3.059 | 3.104 | 0.216 |
| 376_G02 | 3.694 | 3.696 | 3.546 | 0.285 |
| 365_A05 | 2.34 | 2.229 | 3.454 | 0.331 |
| 365_B08 | 1.137 | 1.257 | 3.037 | 0.229 |
| 365_B12 | 2.334 | 2.289 | 3.427 | 0.307 |
| 365_D03 | 2.351 | 2.484 | 3.526 | 0.346 |
| 365_D08 | 2.264 | 2.355 | 3.614 | 0.35 |
| 365_E06 | 1.988 | 2.063 | 3.295 | 0.301 |
| 365_F10 | 2.752 | 2.789 | 3.655 | 0.386 |
| 365_G06 | 2.198 | 2.021 | 3.343 | 0.32 |
| 365_G08 | 2.527 | 2.581 | 3.498 | 0.346 |
| 366_B09 | 2.304 | 2.532 | 3.386 | 0.283 |
| 366_C05 | 2.007 | 2.362 | 3.405 | 0.269 |
| 366_E07 | 1.677 | 1.856 | 3.144 | 0.262 |
| 366_G02 | 2.163 | 2.316 | 3.565 | 0.357 |
| 366_H01 | 2.794 | 2.775 | 3.715 | 0.384 |
| 367_C06 | 2.119 | 2.513 | 3.496 | 0.29 |
| 367_C12 | 2.065 | 2.103 | 3.576 | 0.31 |
| 367_E08 | 2.042 | 2.372 | 3.426 | 0.299 |
| 367_E10 | 2.765 | 2.975 | 3.481 | 0.271 |
| 367_F08 | 2.079 | 2.193 | 3.539 | 0.299 |
| 367_F10 | 2.215 | 2.357 | 3.425 | 0.253 |
| 367_G03 | 2.591 | 2.632 | 3.595 | 0.341 |
| 367_G11 | 2.559 | 2.672 | 3.557 | 0.305 |
| 367_H08 | 2.266 | 2.473 | 3.544 | 0.312 |
| 368_B04 | 2.266 | 2.729 | 3.292 | 0.304 |
| 368_B12 | 2.514 | 2.471 | 3.486 | 0.567 |
| 368_C04 | 2.485 | 2.474 | 3.67 | 0.302 |
| 368_C07 | 2.577 | 2.367 | 3.309 | 0.282 |
| 368_C12 | 2.488 | 2.446 | 3.617 | 0.346 |
| 368_D03 | 2.394 | 2.552 | 3.494 | 0.374 |
| 368_D06 | 2.027 | 2.109 | 3.407 | 0.265 |
| 368_D07 | 2.2 | 2.463 | 3.262 | 0.309 |
| 368_E05 | 1.868 | 2.067 | 3.369 | 0.266 |
| 368_E08 | 2.267 | 2.669 | 3.5 | 0.255 |
| 368_G11 | 2.105 | 2.368 | 3.502 | 0.306 |
| 368_H03 | 2.44 | 2.727 | 3.558 | 0.343 |
| 369_A04 | 2.761 | 2.858 | 3.505 | 0.353 |
| 369_A12 | 3.175 | 3.243 | 3.721 | 0.461 |
| 369_B07 | 2.631 | 2.898 | 3.386 | 0.319 |
| 369_B08 | 2.751 | 2.879 | 3.29 | 0.309 |
| 369_C06 | 2.755 | 3.065 | 3.175 | 0.414 |
| 369_C09 | 2.883 | 3.054 | 3.412 | 0.32 |
| 369_C11 | 2.799 | 2.912 | 3.484 | 0.378 |
| 369_E03 | 3.147 | 3.356 | 3.373 | 0.63 |
| 370_B06 | 2.876 | 3.092 | 3.371 | 0.441 |
| 370_B07 | 1.914 | 2.196 | 3.482 | 0.336 |
| 370_E12 | 3.388 | 3.435 | 3.658 | 0.656 |
| 370_H05 | 2.939 | 3.138 | 3.612 | 0.364 |
| 371_A05 | 3.047 | 3.24 | 3.605 | 0.369 |
| 371_B02 | 2 | 2.279 | 3.59 | 0.449 |
| 371_B11 | 3.182 | 3.261 | 3.594 | 0.549 |
| 371_C02 | 2.918 | 2.877 | 3.656 | 0.372 |
| 371_D05 | 2.718 | 3.112 | 3.438 | 0.339 |
| 371_F07 | 2.784 | 2.893 | 3.342 | 0.425 |
| 371_G07 | 2.8 | 2.988 | 3.413 | 0.548 |
| 372_D07 | 2.684 | 2.993 | 3.704 | 0.472 |
| 373_B01 | 3.258 | 3.584 | 3.114 | 0.197 |
| 373_D11 | 3.572 | 3.546 | 3.202 | 0.364 |
| 373_G06 | 3.397 | 3.525 | 3.231 | 0.196 |
| 374_A10 | 3.557 | 3.587 | 2.999 | 0.23 |
| 374_A12 | 3.312 | 3.256 | 3.063 | 0.308 |
| 374_B01 | 3.143 | 3.369 | 2.918 | 0.173 |
| 374_B07 | 3.713 | 3.705 | 3.295 | 0.25 |
| 374_H02 | 3.263 | 3.257 | 3.183 | 0.197 |
| 375_C03 | 3.001 | 3.243 | 3.162 | 0.217 |
| 375_C05 | 3.457 | 3.584 | 3.316 | 0.193 |
| 375_D02 | 3.629 | 3.558 | 3.202 | 0.191 |
| 375_G08 | 3.332 | 3.432 | 3.267 | 0.259 |
| 375_H04 | 3.106 | 3.159 | 3.148 | 0.181 |
| 376_D08 | 3.815 | 3.711 | 3.471 | 0.232 |
| 376_F09 | 3.501 | 3.588 | 3.353 | 0.25 |
| 376_H12 | 3.234 | 3.082 | 3.487 | 0.344 |
| 365_C05 | 2.564 | 2.808 | 3.527 | 0.271 |
| 365_E10 | 1.823 | 2.053 | 3.337 | 0.273 |
| 365_E12 | 3.321 | 3.276 | 3.522 | 0.338 |
| 365_F02 | 2.781 | 3.049 | 3.396 | 0.326 |
| 365_F03 | 2.631 | 2.99 | 3.574 | 0.347 |
| 365_G03 | 2.242 | 2.543 | 3.543 | 0.321 |
| 365_G04 | 2.096 | 2.48 | 3.295 | 0.295 |
| 365_G05 | 2.442 | 2.539 | 3.352 | 0.319 |
| 365_G09 | 2.617 | 2.933 | 3.671 | 0.288 |
| 365_H07 | 2.514 | 2.745 | 3.431 | 0.33 |
| 366_A06 | 1.97 | 2.254 | 3.24 | 0.334 |
| 366_A08 | 1.653 | 1.734 | 3.23 | 0.243 |
| 366_B05 | 2.385 | 2.461 | 2.955 | 0.24 |
| 366_B07 | 1.796 | 1.915 | 3.222 | 0.215 |
| 366_E01 | 2.693 | 2.717 | 3.66 | 0.397 |
| 366_E08 | 1.973 | 2.002 | 3.349 | 0.272 |
| 366_F02 | 2.149 | 2.108 | 3.597 | 0.371 |
| 366_G12 | 2.713 | 2.828 | 3.586 | 0.372 |
| 366_H04 | 2.69 | 2.829 | 3.524 | 0.359 |
| 367_A03 | 2.576 | 2.451 | 3.438 | 0.347 |
| 367_A06 | 2.339 | 2.566 | 3.358 | 0.378 |
| 367_A08 | 2.057 | 2.091 | 3.337 | 0.252 |
| 367_A10 | 1.892 | 2.163 | 3.392 | 0.315 |
| 367_A12 | 2.439 | 2.416 | 3.647 | 0.39 |
| 367_B01 | 2.839 | 2.907 | 3.674 | 0.408 |
| 367_B04 | 2.664 | 3.099 | 3.342 | 0.265 |
| 367_B12 | 3.015 | 3.028 | 3.745 | 0.414 |
| 367_C07 | 2.468 | 2.516 | 3.414 | 0.387 |
| 367_C10 | 2.529 | 2.61 | 3.386 | 0.233 |
| 367_D03 | 2.594 | 2.451 | 3.455 | 0.29 |
| 367_D06 | 2.045 | 2.353 | 3.25 | 0.283 |
| 367_D08 | 2.183 | 2.373 | 3.501 | 0.237 |
| 367_D12 | 2.435 | 2.689 | 3.569 | 0.309 |
| 367_E05 | 2.353 | 2.639 | 3.466 | 0.333 |
| 367_F01 | 2.425 | 2.757 | 3.724 | 0.33 |
| 367_G01 | 1.8 | 1.944 | 3.578 | 0.356 |
| 367_G04 | 2.978 | 3.042 | 3.356 | 0.287 |
| 367_H02 | 1.077 | 1.199 | 3.616 | 0.378 |
| 367_H03 | 2.041 | 2.2 | 3.341 | 0.377 |
| 368_A03 | 2.834 | 2.833 | 3.411 | 0.348 |
| 368_A04 | 2.349 | 2.352 | 3.565 | 0.283 |
| 368_B09 | 2.543 | 2.808 | 3.434 | 0.258 |
| 368_C02 | 1.377 | 1.488 | 3.513 | 0.321 |
| 368_C08 | 2.259 | 2.432 | 3.383 | 0.289 |
| 368_E12 | 1.286 | 1.554 | 3.652 | 0.347 |
| 368_F09 | 2.389 | 2.449 | 3.578 | 0.242 |
| 368_H02 | 2.406 | 2.544 | 3.578 | 0.348 |
| 368_H05 | 1.954 | 2.197 | 3.342 | 0.277 |
| 369_A07 | 3.548 | 3.564 | 3.421 | 0.288 |
| 369_B05 | 2.777 | 3.057 | 3.44 | 0.314 |
| 369_C05 | 2.545 | 2.718 | 3.022 | 0.32 |
| 369_D03 | 3.277 | 3.554 | 3.606 | 0.391 |
| 369_D07 | 3.069 | 2.914 | 3.259 | 0.363 |
| 369_D09 | 3.303 | 3.051 | 3.446 | 0.287 |
| 369_E06 | 3.134 | 3.109 | 3.515 | 0.306 |
| 369_F08 | 0.503 | 0.589 | 3.099 | 0.302 |
| 369_G08 | 3.297 | 3.492 | 3.582 | 0.312 |

TABLE 4-continued

| Ab | Human ACVR2A | Mouse ACVR2A | Goat anti-Human Kappa | Human Fc |
|---|---|---|---|---|
| 370_A02 | 2.901 | 2.907 | 3.624 | 0.425 |
| 370_B03 | 3.714 | 3.567 | 3.607 | 0.3 |
| 370_B11 | 2.076 | 2.449 | 3.685 | 0.326 |
| 370_B12 | 2.925 | 3.077 | 3.563 | 0.478 |
| 370_D01 | 3.137 | 3.17 | 3.664 | 0.382 |
| 370_D05 | 2.976 | 3.125 | 3.49 | 0.333 |
| 370_F03 | 1.136 | 1.25 | 3.301 | 0.373 |
| 370_H02 | 3.301 | 3.39 | 3.667 | 0.386 |
| 370_H07 | 3 | 3.245 | 3.511 | 0.403 |
| 371_A10 | 2.812 | 2.779 | 3.477 | 0.338 |
| 371_B03 | 1.634 | 1.935 | 3.482 | 0.367 |
| 371_B04 | 2.465 | 3.129 | 2.269 | 0.295 |
| 371_B09 | 0.825 | 0.827 | 2.702 | 0.292 |
| 371_B12 | 2.555 | 2.4 | 3.483 | 0.378 |
| 371_C01 | 2.001 | 2.273 | 3.594 | 0.402 |
| 371_C04 | 2.049 | 2.246 | 3.453 | 0.314 |
| 371_C05 | 1.24 | 1.355 | 3.079 | 0.269 |
| 371_C12 | 3.099 | 3.196 | 3.683 | 0.544 |
| 371_D02 | 2.939 | 2.991 | 3.578 | 0.385 |
| 371_D04 | 1.023 | 1.295 | 3.3 | 0.276 |
| 371_E06 | 3.003 | 3.029 | 3.443 | 0.33 |
| 371_E07 | 3.091 | 3.348 | 3.437 | 0.337 |
| 371_E10 | 3.062 | 3.052 | 3.486 | 0.341 |
| 371_F10 | 2.339 | 2.31 | 3.529 | 0.299 |
| 371_F11 | 3.039 | 3.253 | 3.676 | 0.331 |
| 371_G02 | 3.118 | 3.06 | 3.673 | 0.514 |
| 371_G04 | 3.625 | 3.577 | 3.544 | 0.325 |
| 371_G09 | 2.745 | 3.066 | 3.577 | 0.315 |
| 371_G11 | 2.84 | 2.752 | 3.666 | 0.399 |
| 371_H04 | 3.258 | 3.507 | 3.576 | 0.35 |
| 371_H05 | 1.202 | 1.245 | 3.271 | 0.321 |
| 371_H06 | 3.027 | 3.111 | 3.698 | 0.346 |
| 371_H08 | 1.662 | 2.039 | 3.472 | 0.309 |
| 371_H10 | 2.189 | 2.553 | 3.548 | 0.358 |
| 372_B02 | 3.172 | 3.509 | 3.665 | 0.371 |
| 372_C06 | 3.206 | 3.536 | 3.491 | 0.489 |
| 372_D03 | 3.042 | 3.289 | 3.603 | 0.319 |
| 372_E01 | 3.341 | 3.34 | 3.598 | 0.409 |
| 372_G12 | 2.409 | 2.725 | 3.495 | 0.439 |
| 373_A01 | 3.177 | 3.477 | 2.952 | 0.177 |
| 373_A03 | 3.647 | 3.634 | 3.079 | 0.189 |
| 373_A05 | 3.45 | 3.423 | 3.033 | 0.172 |
| 373_A09 | 3.66 | 3.615 | 3.107 | 0.248 |
| 373_A11 | 3.763 | 3.679 | 3.086 | 0.184 |
| 373_A12 | 3.59 | 3.315 | 3.093 | 0.179 |
| 373_B05 | 3.586 | 3.526 | 3.233 | 0.184 |
| 373_B07 | 3.661 | 3.61 | 3.304 | 0.208 |
| 373_C03 | 3.69 | 3.654 | 3.304 | 0.171 |
| 373_C07 | 3.569 | 3.578 | 3.298 | 0.206 |
| 373_C10 | 3.653 | 3.645 | 3.235 | 0.318 |
| 373_D03 | 3.745 | 3.694 | 3.18 | 0.18 |
| 373_D12 | 3.398 | 3.207 | 3.212 | 0.224 |
| 373_E10 | 3.722 | 3.636 | 3.2 | 0.188 |
| 373_F08 | 3.76 | 3.701 | 3.215 | 0.202 |
| 373_F11 | 3.354 | 3.46 | 3.319 | 0.204 |
| 373_F12 | 3.245 | 3.217 | 3.063 | 0.158 |
| 373_G08 | 3.651 | 3.673 | 3.284 | 0.172 |
| 373_H03 | 3.268 | 3.289 | 3.221 | 0.172 |
| 373_H07 | 3.253 | 3.27 | 3.233 | 0.199 |
| 373_H09 | 0.93 | 1.354 | 3.084 | 0.166 |
| 374_A06 | 3.775 | 3.747 | 2.999 | 0.173 |
| 374_A09 | 3.583 | 3.644 | 2.971 | 0.231 |
| 374_B03 | 3.687 | 3.697 | 3.066 | 0.166 |
| 374_B05 | 3.681 | 3.652 | 3.164 | 0.168 |
| 374_B08 | 3.6 | 3.629 | 3.124 | 0.188 |
| 374_B10 | 3.711 | 3.686 | 3.004 | 0.17 |
| 374_C01 | 2.685 | 2.929 | 3.078 | 0.167 |
| 374_C09 | 3.431 | 3.509 | 3.14 | 0.154 |
| 374_C12 | 3.667 | 3.326 | 3.145 | 0.308 |
| 374_D03 | 3.3 | 3.48 | 3.025 | 0.216 |
| 374_D05 | 3.434 | 3.565 | 3.148 | 0.171 |
| 374_D06 | 3.776 | 3.674 | 3.123 | 0.172 |
| 374_D07 | 3.71 | 3.684 | 3.26 | 0.176 |
| 374_D10 | 3.562 | 3.638 | 3.273 | 0.329 |
| 374_E10 | 3.736 | 3.768 | 3.375 | 0.165 |
| 374_E12 | 3.613 | 3.284 | 3.293 | 0.177 |
| 374_F06 | 3.723 | 3.704 | 3.179 | 0.201 |
| 374_F07 | 3.467 | 3.542 | 3.209 | 0.176 |
| 374_F08 | 3.671 | 3.676 | 3.176 | 0.211 |
| 374_G03 | 3.791 | 3.64 | 3.219 | 0.193 |
| 374_G08 | 3.706 | 3.704 | 3.211 | 0.206 |
| 374_G09 | 3.656 | 3.598 | 3.258 | 0.223 |
| 374_G10 | 3.681 | 3.737 | 3.233 | 0.173 |
| 374_G11 | 3.651 | 3.597 | 3.245 | 0.179 |
| 374_H01 | 3.084 | 3.261 | 3.068 | 0.251 |
| 374_H11 | 3.275 | 3.285 | 3.15 | 0.169 |
| 375_A01 | 3.281 | 3.676 | 2.908 | 0.196 |
| 375_A07 | 3.575 | 3.644 | 3.11 | 0.188 |
| 375_A08 | 3.676 | 3.687 | 3.14 | 0.205 |
| 375_A12 | 3.657 | 3.347 | 3.137 | 0.174 |
| 375_B12 | 3.654 | 3.338 | 3.28 | 0.223 |
| 375_C04 | 3.677 | 3.675 | 3.207 | 0.221 |
| 375_D01 | 3.298 | 3.608 | 3.1 | 0.182 |
| 375_D10 | 3.258 | 3.454 | 3.207 | 0.228 |
| 375_E02 | 3.582 | 3.691 | 3.199 | 0.496 |
| 375_E03 | 3.568 | 3.638 | 3.184 | 0.181 |
| 375_E05 | 3.669 | 3.709 | 3.283 | 0.296 |
| 375_E06 | 3.846 | 3.672 | 3.328 | 0.188 |
| 375_E10 | 3.689 | 3.792 | 3.293 | 0.187 |
| 375_F02 | 3.605 | 3.646 | 3.203 | 0.205 |
| 375_F07 | 3.675 | 3.707 | 3.216 | 0.172 |
| 375_F08 | 3.502 | 3.581 | 3.315 | 0.201 |
| 375_G04 | 2.909 | 3.294 | 3.193 | 0.161 |
| 375_G05 | 3.712 | 3.745 | 3.264 | 0.21 |
| 375_H05 | 3.355 | 3.331 | 3.171 | 0.167 |
| 375_H07 | 3.304 | 3.293 | 3.273 | 0.346 |
| 376_A03 | 3.613 | 3.65 | 3.231 | 0.328 |
| 376_B03 | 3.678 | 3.668 | 3.519 | 0.253 |
| 376_B10 | 3.595 | 3.665 | 3.457 | 0.232 |
| 376_C04 | 3.63 | 3.654 | 3.397 | 0.219 |
| 376_C08 | 3.612 | 3.627 | 3.462 | 0.246 |
| 376_D07 | 3.381 | 3.444 | 3.436 | 0.318 |
| 376_E02 | 3.298 | 3.376 | 3.408 | 0.222 |
| 376_E11 | 3.682 | 3.646 | 3.471 | 0.268 |
| 376_F01 | 2.769 | 3.015 | 3.177 | 0.199 |
| 376_F06 | 3.525 | 3.649 | 3.469 | 0.284 |
| 376_G05 | 3.745 | 3.773 | 3.489 | 0.252 |
| 376_G06 | 3.424 | 3.58 | 3.489 | 0.267 |
| 376_G10 | 3.545 | 3.524 | 3.542 | 0.321 |
| 376_H01 | 3.113 | 3.308 | 3.277 | 0.607 |
| 376_H04 | 3.309 | 3.338 | 3.513 | 0.34 |
| 376_H11 | 3.293 | 3.309 | 3.433 | 0.325 |
| 365_A08 | 1.584 | 1.593 | 3.2 | 0.256 |
| 365_A09 | 2.449 | 2.479 | 3.302 | 0.339 |
| 365_C02 | 2.155 | 2.332 | 3.447 | 0.362 |
| 365_C04 | 2.262 | 2.673 | 3.551 | 0.305 |
| 365_D02 | 2.539 | 2.699 | 3.518 | 0.486 |
| 365_D07 | 1.831 | 2.058 | 3.382 | 0.302 |
| 365_D10 | 2.393 | 2.236 | 3.272 | 0.641 |
| 365_E11 | 1.741 | 1.736 | 3.568 | 0.301 |
| 365_F05 | 2.141 | 2.232 | 3.416 | 0.376 |
| 365_H05 | 2.102 | 2.195 | 3.46 | 0.361 |
| 366_D08 | 2.166 | 2.463 | 3.65 | 0.312 |
| 366_F08 | 1.862 | 2.004 | 3.468 | 0.316 |
| 366_G09 | 1.855 | 2.041 | 3.435 | 0.291 |
| 367_A02 | 2.231 | 2.416 | 3.581 | 0.305 |
| 367_B06 | 1.817 | 1.889 | 3.019 | 0.378 |
| 367_C08 | 1.119 | 1.218 | 3.054 | 0.278 |
| 367_D05 | 1.26 | 1.373 | 3.341 | 0.265 |
| 367_D09 | 2.147 | 2.045 | 3.372 | 0.381 |
| 367_E07 | 1.935 | 2.055 | 3.215 | 0.221 |
| 367_E12 | 2.695 | 2.913 | 3.706 | 0.453 |
| 367_F09 | 1.795 | 1.818 | 3.455 | 0.289 |
| 367_H05 | 2.439 | 2.698 | 3.59 | 0.51 |
| 367_H10 | 2.577 | 2.353 | 3.55 | 0.326 |
| 368_B02 | 2.075 | 2.24 | 3.606 | 0.337 |
| 368_C11 | 2.027 | 2.209 | 3.558 | 0.275 |
| 368_D02 | 1.925 | 2.26 | 3.522 | 0.321 |
| 368_D12 | 2.254 | 2.283 | 3.568 | 0.329 |
| 368_F06 | 1.599 | 1.68 | 3.315 | 0.249 |

TABLE 4-continued

| Ab | Human ACVR2A | Mouse ACVR2A | Goat anti-Human Kappa | Human Fc |
|---|---|---|---|---|
| 368_G03 | 2.726 | 2.746 | 3.392 | 0.312 |
| 368_G10 | 2.064 | 2.283 | 3.454 | 0.356 |
| 368_H06 | 2.351 | 2.654 | 3.612 | 0.311 |
| 368_H11 | 1.954 | 2.129 | 3.511 | 0.355 |
| 369_A11 | 2.643 | 2.774 | 3.286 | 0.366 |
| 369_C12 | 3.43 | 3.447 | 3.742 | 0.418 |
| 369_D08 | 2.942 | 3.127 | 3.063 | 0.241 |
| 369_E05 | 1.405 | 1.642 | 1.904 | 0.282 |
| 369_E08 | 1.028 | 1.227 | 1.116 | 0.272 |
| 369_F05 | 0.796 | 0.931 | 3.46 | 0.331 |
| 369_F09 | 3.227 | 3.381 | 3.601 | 0.5 |
| 369_G05 | 3.036 | 3.278 | 3.309 | 0.384 |
| 369_H02 | 3.088 | 3.29 | 3.572 | 0.408 |
| 369_H08 | 3.159 | 3.231 | 3.556 | 0.389 |
| 369_H12 | 3.463 | 3.42 | 3.652 | 0.414 |
| 370_B08 | 3.131 | 3.247 | 3.353 | 0.302 |
| 370_C06 | 3.141 | 3.414 | 3.55 | 0.303 |
| 370_C07 | 3.351 | 3.369 | 3.299 | 0.316 |
| 370_C10 | 1.3 | 1.383 | 3.352 | 0.332 |
| 370_D03 | 3.135 | 3.249 | 3.582 | 0.57 |
| 370_D09 | 2.924 | 2.531 | 3.484 | 0.287 |
| 370_E04 | 2.572 | 2.721 | 3.398 | 0.292 |
| 370_E05 | 2.585 | 2.768 | 3.519 | 0.427 |
| 370_F01 | 3.004 | 3.136 | 3.669 | 0.407 |
| 370_F02 | 2.682 | 2.891 | 3.627 | 0.376 |
| 370_F12 | 3.551 | 3.572 | 3.644 | 0.457 |
| 370_G08 | 3.212 | 3.326 | 3.564 | 0.364 |
| 370_H04 | 3.484 | 3.558 | 3.615 | 0.596 |
| 370_H06 | 3.22 | 3.394 | 3.514 | 0.358 |
| 371_B01 | 3.26 | 3.271 | 3.584 | 0.464 |
| 371_C06 | 2.486 | 3.012 | 3.435 | 0.308 |
| 371_C07 | 1.391 | 1.446 | 3.359 | 0.287 |
| 371_E05 | 2.989 | 3.178 | 3.446 | 0.59 |
| 371_E08 | 2.114 | 2.267 | 2.64 | 0.251 |
| 371_E09 | 2.078 | 2.283 | 3.155 | 0.306 |
| 371_E12 | 3.09 | 2.993 | 3.622 | 0.398 |
| 371_F03 | 1.19 | 1.302 | 1.819 | 0.252 |
| 371_F09 | 3.369 | 3.57 | 3.597 | 0.602 |
| 371_G01 | 2.014 | 2.242 | 1.786 | 0.375 |
| 371_H11 | 2.89 | 3.121 | 3.597 | 0.363 |
| 372_B09 | 3.108 | 3.011 | 3.502 | 0.308 |
| 372_E08 | 2.559 | 2.816 | 3.507 | 0.369 |
| 372_F02 | 3.006 | 3.094 | 3.695 | 0.411 |
| 372_H11 | 2.616 | 2.86 | 3.645 | 0.392 |
| 373_A06 | 3.636 | 3.624 | 3.073 | 0.193 |
| 373_B09 | 3.6 | 3.621 | 3.242 | 0.172 |
| 373_D06 | 3.633 | 3.574 | 3.208 | 0.192 |
| 373_F07 | 3.613 | 3.62 | 3.129 | 0.172 |
| 373_G02 | 3.59 | 3.559 | 3.223 | 0.226 |
| 374_A04 | 3.654 | 3.682 | 2.99 | 0.275 |
| 374_A05 | 3.604 | 3.6 | 2.923 | 0.159 |
| 374_C10 | 3.567 | 3.671 | 3.08 | 0.174 |
| 374_D04 | 3.629 | 3.649 | 3.053 | 0.179 |
| 374_D09 | 3.609 | 3.646 | 3.096 | 0.171 |
| 374_G05 | 3.658 | 3.667 | 3.003 | 0.158 |
| 374_H05 | 3.315 | 3.297 | 3.042 | 0.257 |
| 375_A03 | 3.615 | 3.619 | 3.087 | 0.203 |
| 375_B03 | 3.678 | 3.7 | 3.241 | 0.209 |
| 375_C01 | 2.962 | 3.27 | 3.136 | 0.191 |
| 375_C11 | 3.589 | 3.613 | 3.263 | 0.199 |
| 375_F10 | 3.691 | 3.767 | 3.295 | 0.21 |
| 375_H08 | 3.308 | 3.28 | 3.324 | 0.204 |
| 376_A02 | 3.716 | 3.634 | 3.194 | 0.22 |
| 376_A05 | 3.648 | 3.644 | 3.184 | 0.256 |
| 376_A07 | 3.7 | 3.722 | 3.193 | 0.221 |
| 365_A03 | 3.4 | 3.243 | 3.443 | 0.342 |
| 365_A11 | 2.039 | 1.937 | 3.267 | 0.299 |
| 365_A12 | 2.674 | 2.871 | 3.668 | 0.422 |
| 365_B01 | 2.386 | 2.646 | 3.491 | 0.445 |
| 365_B06 | 2.246 | 2.418 | 3.277 | 0.281 |
| 365_B07 | 2.112 | 2.213 | 3.229 | 0.269 |
| 365_B11 | 2.844 | 2.755 | 3.581 | 0.305 |
| 365_C01 | 2.869 | 3.025 | 3.626 | 0.376 |
| 365_C10 | 2.451 | 2.441 | 3.413 | 0.397 |
| 365_C11 | 2.656 | 2.781 | 3.668 | 0.296 |
| 365_C12 | 1.924 | 2.04 | 3.576 | 0.332 |
| 365_D09 | 1.523 | 1.35 | 3.375 | 0.302 |
| 365_D11 | 2.342 | 2.224 | 3.382 | 0.299 |
| 365_D12 | 2.567 | 2.613 | 3.53 | 0.34 |
| 365_E01 | 2.906 | 2.837 | 3.542 | 0.363 |
| 365_E05 | 2.181 | 2.437 | 3.36 | 0.379 |
| 365_E07 | 2.383 | 2.701 | 3.513 | 0.302 |
| 365_E09 | 1.906 | 2.16 | 3.474 | 0.322 |
| 365_F01 | 2.51 | 2.471 | 3.509 | 0.341 |
| 365_F06 | 1.953 | 2.082 | 3.397 | 0.329 |
| 365_F12 | 2.913 | 2.828 | 3.633 | 0.411 |
| 365_G01 | 2.483 | 2.647 | 3.447 | 0.39 |
| 365_G11 | 1.745 | 1.785 | 3.473 | 0.278 |
| 365_H02 | 2.732 | 2.908 | 3.58 | 0.407 |
| 365_H03 | 2.322 | 2.654 | 3.269 | 0.366 |
| 365_H06 | 2.244 | 2.459 | 3.437 | 0.367 |
| 365_H10 | 2.677 | 2.823 | 3.513 | 0.349 |
| 365_H11 | 3.239 | 3.353 | 3.614 | 0.375 |
| 365_H12 | 2.968 | 2.908 | 3.778 | 0.451 |
| 366_A07 | 2.417 | 2.679 | 3.365 | 0.309 |
| 366_B08 | 2.148 | 2.376 | 3.054 | 0.403 |
| 366_B10 | 2.328 | 2.444 | 3.059 | 0.424 |
| 366_B12 | 3.244 | 2.989 | 3.444 | 0.311 |
| 366_D04 | 2.079 | 2.125 | 3.463 | 0.338 |
| 366_E10 | 2.354 | 2.389 | 3.454 | 0.271 |
| 366_F04 | 1.726 | 1.912 | 3.366 | 0.281 |
| 366_F05 | 2.191 | 2.668 | 3.245 | 0.279 |
| 366_F07 | 2.386 | 2.534 | 3.473 | 0.353 |
| 366_G04 | 1.851 | 2.176 | 3.286 | 0.31 |
| 366_G05 | 2.212 | 2.496 | 3.262 | 0.28 |
| 366_H06 | 2.289 | 2.591 | 3.386 | 0.285 |
| 366_H07 | 2.526 | 2.673 | 3.605 | 0.285 |
| 366_H08 | 2.593 | 2.77 | 3.551 | 0.417 |
| 366_H09 | 2.095 | 2.437 | 3.423 | 0.328 |
| 367_A04 | 2.142 | 2.202 | 3.303 | 0.267 |
| 367_A05 | 2.218 | 2.384 | 3.381 | 0.269 |
| 367_B02 | 2.288 | 2.422 | 3.533 | 0.302 |
| 367_B03 | 2.479 | 2.659 | 3.445 | 0.318 |
| 367_B07 | 1.419 | 1.488 | 3.337 | 0.236 |
| 367_B08 | 2.128 | 2.245 | 3.033 | 0.37 |
| 367_C01 | 2.617 | 2.987 | 3.71 | 0.348 |
| 367_C05 | 2.215 | 2.856 | 3.424 | 0.255 |
| 367_C11 | 2.329 | 2.545 | 3.449 | 0.45 |
| 367_D10 | 2.699 | 2.667 | 3.38 | 0.251 |
| 367_E01 | 2.546 | 2.523 | 3.607 | 0.351 |
| 367_E04 | 2.406 | 2.573 | 3.501 | 0.284 |
| 367_E06 | 2.022 | 2.313 | 3.477 | 0.271 |
| 367_E09 | 1.664 | 1.81 | 3.329 | 0.249 |
| 367_E11 | 2.395 | 2.909 | 3.607 | 0.244 |
| 367_F03 | 2.1 | 2.392 | 3.446 | 0.301 |
| 367_F07 | 2.126 | 2.246 | 3.261 | 0.242 |
| 367_F11 | 1.714 | 1.873 | 3.477 | 0.267 |
| 367_G05 | 2.41 | 2.711 | 3.371 | 0.283 |
| 367_G06 | 2.641 | 2.81 | 3.348 | 0.28 |
| 367_G10 | 2.115 | 2.316 | 3.448 | 0.286 |
| 367_H06 | 2.695 | 3.083 | 3.651 | 0.313 |
| 367_H11 | 2.371 | 2.693 | 3.609 | 0.323 |
| 368_A01 | 2.994 | 2.9 | 3.683 | 0.396 |
| 368_A05 | 2.708 | 2.696 | 3.459 | 0.285 |
| 368_A07 | 2.11 | 2.312 | 3.65 | 0.261 |
| 368_A09 | 2.51 | 2.628 | 3.549 | 0.277 |
| 368_B01 | 2.607 | 2.588 | 3.705 | 0.365 |
| 368_B06 | 2.059 | 2.341 | 3.157 | 0.393 |
| 368_B07 | 1.909 | 2.065 | 3.135 | 0.344 |
| 368_C05 | 1.818 | 2.018 | 3.359 | 0.246 |
| 368_D01 | 2.751 | 2.971 | 3.647 | 0.319 |
| 368_D04 | 2.461 | 2.699 | 3.666 | 0.338 |
| 368_D05 | 2.857 | 2.868 | 3.385 | 0.282 |
| 368_D11 | 2.796 | 2.96 | 3.487 | 0.297 |
| 368_E01 | 2.566 | 2.849 | 3.736 | 0.392 |
| 368_E02 | 2.5 | 2.788 | 3.679 | 0.424 |
| 368_E04 | 3.08 | 3.232 | 3.476 | 0.32 |
| 368_E06 | 2.328 | 2.339 | 3.505 | 0.325 |
| 368_E07 | 1.067 | 1.169 | 3.453 | 0.251 |
| 368_F03 | 2.352 | 2.601 | 3.604 | 0.323 |

TABLE 4-continued

| Ab | Human ACVR2A | Mouse ACVR2A | Goat anti-Human Kappa | Human Fc |
|---|---|---|---|---|
| 368_F11 | 2.578 | 2.726 | 3.526 | 0.338 |
| 368_G01 | 2.646 | 2.824 | 3.622 | 0.431 |
| 368_G12 | 2.457 | 2.535 | 3.518 | 0.341 |
| 368_H04 | 1.063 | 1.362 | 3.513 | 0.319 |
| 369_A02 | 3.147 | 3.457 | 3.493 | 0.383 |
| 369_A03 | 0.451 | 0.561 | 3.169 | 0.347 |
| 369_B01 | 3.358 | 3.457 | 3.588 | 0.487 |
| 369_C02 | 3.6 | 3.517 | 3.543 | 0.369 |
| 369_C03 | 3.371 | 3.649 | 3.516 | 0.323 |
| 369_C04 | 1.639 | 1.649 | 2.459 | 0.248 |
| 369_D01 | 3.127 | 3.317 | 3.63 | 0.595 |
| 369_D02 | 3.287 | 3.436 | 3.527 | 0.407 |
| 369_D04 | 3.054 | 2.968 | 3.589 | 0.435 |
| 369_D12 | 3.041 | 3.105 | 3.533 | 0.425 |
| 369_E02 | 2.144 | 2.341 | 3.429 | 0.365 |
| 369_E11 | 2.889 | 3.202 | 3.694 | 0.343 |
| 369_E12 | 2.464 | 2.692 | 3.667 | 0.452 |
| 369_F01 | 3.278 | 3.418 | 3.469 | 0.554 |
| 369_F02 | 3.071 | 3.35 | 3.556 | 0.478 |
| 369_F03 | 2.575 | 2.749 | 3.438 | 0.389 |
| 369_F06 | 3.109 | 3.066 | 3.51 | 0.353 |
| 369_F10 | 3.048 | 3.225 | 3.667 | 0.361 |
| 369_F11 | 3.196 | 3.373 | 3.657 | 0.37 |
| 369_G01 | 3.567 | 3.666 | 3.439 | 0.403 |
| 369_G04 | 2.365 | 2.685 | 3.316 | 0.385 |
| 369_G06 | 2.98 | 2.914 | 3.378 | 0.474 |
| 369_G11 | 3.028 | 3.06 | 2.594 | 0.331 |
| 369_G12 | 1.768 | 1.882 | 2.652 | 0.353 |
| 369_H05 | 3.249 | 3.342 | 3.54 | 0.457 |
| 369_H06 | 3.235 | 3.555 | 3.5 | 0.347 |
| 369_H09 | 2.364 | 2.643 | 3.507 | 0.365 |
| 370_A01 | 2.859 | 2.955 | 3.622 | 0.637 |
| 370_A03 | 3.544 | 3.633 | 3.564 | 0.424 |
| 370_A04 | 2.566 | 2.736 | 3.476 | 0.377 |
| 370_A12 | 3.062 | 3.188 | 3.719 | 0.674 |
| 370_C01 | 3.285 | 3.38 | 3.615 | 0.403 |
| 370_C03 | 3.592 | 3.773 | 3.571 | 0.35 |
| 370_C05 | 3.208 | 3.546 | 3.557 | 0.346 |
| 370_C08 | 2.73 | 2.967 | 3.111 | 0.381 |
| 370_C09 | 1.974 | 2.248 | 3.483 | 0.292 |
| 370_D04 | 3.59 | 3.737 | 3.6 | 0.371 |
| 370_D11 | 2.721 | 2.794 | 3.381 | 0.34 |
| 370_E03 | 3.636 | 3.738 | 3.57 | 0.361 |
| 370_E06 | 2.903 | 3.025 | 3.608 | 0.375 |
| 370_E09 | 3.45 | 3.555 | 3.597 | 0.338 |
| 370_F05 | 2.758 | 2.913 | 3.536 | 0.406 |
| 370_F07 | 3.451 | 3.534 | 3.515 | 0.384 |
| 370_F10 | 3.145 | 3.216 | 3.636 | 0.441 |
| 370_G02 | 2.982 | 3.22 | 3.625 | 0.388 |
| 370_G03 | 3.103 | 3.435 | 3.579 | 0.421 |
| 370_G06 | 2.191 | 2.334 | 3.408 | 0.356 |
| 370_G09 | 3.006 | 3.136 | 3.641 | 0.393 |
| 370_G10 | 2.985 | 2.744 | 3.49 | 0.315 |
| 370_G11 | 2.975 | 3.07 | 3.72 | 0.529 |
| 370_H01 | 3.31 | 3.179 | 3.651 | 0.436 |
| 370_H09 | 2.948 | 3.277 | 3.542 | 0.348 |
| 371_A03 | 2.843 | 2.622 | 3.563 | 0.354 |
| 371_A06 | 2.65 | 2.786 | 3.51 | 0.337 |
| 371_A07 | 2.875 | 3.059 | 3.651 | 0.336 |
| 371_A08 | 1.061 | 1.161 | 2.442 | 0.304 |
| 371_A12 | 3.168 | 3.299 | 3.631 | 0.483 |
| 371_B06 | 2.692 | 2.712 | 3.296 | 0.356 |
| 371_B07 | 2.779 | 3.045 | 3.329 | 0.308 |
| 371_C03 | 3.013 | 3.241 | 3.598 | 0.311 |
| 371_D06 | 1.477 | 1.555 | 3.322 | 0.295 |
| 371_D09 | 2.889 | 2.936 | 2.168 | 0.268 |
| 371_F01 | 2.41 | 2.618 | 3.678 | 0.41 |
| 371_F04 | 2.946 | 3.102 | 3.66 | 0.345 |
| 371_F06 | 2.414 | 2.795 | 3.456 | 0.289 |
| 371_F08 | 2.196 | 2.546 | 3.427 | 0.301 |
| 371_G05 | 1.249 | 1.329 | 3.082 | 0.313 |
| 371_G10 | 1.646 | 1.922 | 3.406 | 0.439 |
| 371_H09 | 2.962 | 3.225 | 3.656 | 0.32 |
| 372_A04 | 3.204 | 3.404 | 3.643 | 0.339 |
| 372_B04 | 2.611 | 3.122 | 3.59 | 0.333 |
| 372_C07 | 2.409 | 2.638 | 3.462 | 0.279 |
| 372_D02 | 2.657 | 2.907 | 3.579 | 0.433 |
| 372_F03 | 3.192 | 3.308 | 3.595 | 0.438 |
| 372_F06 | 2.259 | 2.539 | 3.483 | 0.38 |
| 372_F08 | 3.382 | 3.217 | 3.445 | 0.335 |
| 372_F09 | 3.166 | 3.043 | 3.474 | 0.268 |
| 373_A02 | 2.803 | 2.974 | 2.955 | 0.159 |
| 373_A08 | 3.301 | 3.309 | 3.112 | 0.195 |
| 373_A10 | 3.544 | 3.55 | 3.096 | 0.175 |
| 373_B04 | 3.605 | 3.617 | 3.255 | 0.176 |
| 373_B06 | 3.441 | 3.43 | 3.236 | 0.221 |
| 373_B10 | 3.655 | 3.597 | 3.15 | 0.174 |
| 373_B12 | 3.122 | 3.075 | 3.27 | 0.172 |
| 373_C02 | 3.452 | 3.466 | 3.146 | 0.17 |
| 373_C04 | 3.356 | 3.502 | 3.196 | 0.157 |
| 373_C06 | 3.545 | 3.531 | 3.163 | 0.163 |
| 373_C08 | 3.048 | 3.193 | 3.189 | 0.16 |
| 373_C11 | 3.49 | 3.468 | 3.168 | 0.171 |
| 373_D01 | 3.235 | 3.574 | 3.041 | 0.174 |
| 373_D04 | 3.678 | 3.646 | 3.154 | 0.168 |
| 373_D05 | 3.683 | 3.734 | 3.253 | 0.179 |
| 373_D08 | 3.656 | 3.665 | 3.241 | 0.182 |
| 373_D10 | 3.61 | 3.61 | 3.114 | 0.189 |
| 373_E01 | 2.347 | 2.56 | 2.986 | 0.16 |
| 373_E05 | 3.545 | 3.592 | 3.24 | 0.176 |
| 373_E07 | 3.483 | 3.536 | 3.231 | 0.294 |
| 373_E12 | 3.627 | 3.333 | 3.116 | 0.17 |
| 373_G10 | 3.538 | 3.563 | 3.261 | 0.2 |
| 373_G12 | 3.472 | 3.288 | 3.259 | 0.174 |
| 373_H01 | 3.104 | 3.28 | 3.123 | 0.198 |
| 373_H05 | 3.286 | 3.295 | 3.216 | 0.201 |
| 374_A07 | 3.624 | 3.712 | 3.072 | 0.206 |
| 374_B04 | 3.67 | 3.641 | 3.3 | 0.222 |
| 374_B06 | 3.482 | 3.595 | 3.084 | 0.157 |
| 374_B12 | 3.489 | 3.326 | 3.054 | 0.257 |
| 374_C03 | 3.583 | 3.612 | 3.056 | 0.208 |
| 374_C06 | 3.715 | 3.712 | 3.236 | 0.18 |
| 374_D01 | 3.244 | 3.578 | 2.935 | 0.198 |
| 374_D08 | 3.503 | 3.591 | 3.017 | 0.201 |
| 374_E01 | 3.238 | 3.556 | 3.037 | 0.235 |
| 374_E02 | 2.235 | 3.329 | 3.176 | 0.527 |
| 374_E05 | 3.561 | 3.568 | 3.176 | 0.244 |
| 374_E07 | 3.632 | 3.581 | 3.203 | 0.3 |
| 374_E08 | 3.496 | 3.524 | 3.263 | 0.251 |
| 374_E11 | 3.607 | 3.586 | 3.343 | 0.186 |
| 374_F01 | 3.291 | 3.597 | 3.026 | 0.165 |
| 374_F02 | 3.565 | 3.586 | 3.157 | 0.169 |
| 374_F04 | 3.576 | 3.645 | 3.228 | 0.163 |
| 374_F10 | 3.211 | 3.453 | 3.283 | 0.524 |
| 374_F11 | 3.657 | 3.608 | 3.151 | 0.191 |
| 374_G04 | 2.096 | 2.317 | 3.025 | 0.161 |
| 374_G06 | 3.256 | 3.421 | 3.289 | 0.25 |
| 374_G07 | 3.631 | 3.723 | 3.257 | 0.214 |
| 374_H03 | 3.265 | 3.268 | 3.065 | 0.162 |
| 374_H04 | 3.277 | 3.31 | 3.189 | 0.167 |
| 374_H06 | 3.297 | 3.264 | 3.081 | 0.166 |
| 374_H07 | 3.241 | 3.251 | 2.973 | 0.163 |
| 374_H09 | 3.249 | 3.264 | 3.039 | 0.158 |
| 375_A05 | 3.721 | 3.685 | 3.12 | 0.202 |
| 375_C06 | 2.646 | 3.212 | 3.289 | 0.2 |
| 375_D04 | 3.691 | 3.699 | 3.166 | 0.182 |
| 375_D05 | 3.465 | 3.609 | 3.215 | 0.202 |
| 375_D07 | 3.563 | 3.633 | 3.253 | 0.176 |
| 375_D08 | 3.287 | 3.403 | 3.302 | 0.234 |
| 375_D12 | 3.24 | 3.156 | 3.23 | 0.193 |
| 375_E01 | 3.159 | 3.627 | 3.111 | 0.164 |
| 375_E07 | 3.683 | 3.81 | 3.06 | 0.158 |
| 375_H12 | 3.256 | 3.104 | 3.263 | 0.188 |
| 376_A04 | 3.587 | 3.578 | 3.123 | 0.245 |
| 376_A10 | 3.676 | 3.642 | 3.174 | 0.279 |
| 376_A12 | 3.696 | 3.341 | 3.217 | 0.22 |
| 376_B04 | 3.409 | 3.479 | 3.577 | 0.293 |
| 376_B05 | 3.646 | 3.778 | 3.519 | 0.242 |
| 376_B09 | 3.777 | 3.717 | 3.506 | 0.227 |
| 376_B11 | 3.69 | 3.753 | 3.608 | 0.261 |

TABLE 4-continued

| Ab | Human ACVR2A | Mouse ACVR2A | Goat anti-Human Kappa | Human Fc |
|---|---|---|---|---|
| 376_C01 | 3.264 | 3.599 | 3.198 | 0.324 |
| 376_C02 | 3.445 | 3.529 | 3.443 | 0.222 |
| 376_C12 | 3.698 | 3.322 | 3.391 | 0.438 |
| 376_D05 | 3.599 | 3.707 | 3.337 | 0.215 |
| 376_D11 | 3.698 | 3.621 | 3.433 | 0.267 |
| 376_E03 | 3.788 | 3.744 | 3.425 | 0.234 |
| 376_E08 | 3.64 | 3.638 | 3.473 | 0.332 |
| 376_F03 | 3.289 | 3.471 | 3.443 | 0.261 |
| 376_F04 | 3.066 | 3.29 | 3.415 | 0.222 |
| 376_G08 | 3.695 | 3.637 | 3.473 | 0.22 |
| 376_G09 | 3.678 | 3.646 | 3.446 | 0.23 |
| 376_H09 | 3.318 | 3.299 | 3.455 | 0.281 |
| 376_H10 | 3.28 | 3.293 | 3.538 | 0.318 |
| 365_E02 | 2.446 | 2.609 | 3.503 | 0.357 |
| 370_G12 | 1.337 | 1.6 | 3.523 | 0.418 |
| 368_C01 | 2.607 | 2.922 | 3.714 | 0.41 |
| 376_C06 | 3.487 | 3.563 | 3.43 | 0.29 |
| 368_D10 | 2.245 | 2.449 | 3.258 | 0.245 |
| 365_G12 | 2.742 | 2.748 | 3.548 | 0.556 |
| 367_C03 | 2.301 | 2.808 | 3.513 | 0.275 |
| 367_H07 | 2.719 | 2.684 | 3.463 | 0.297 |
| 371_D03 | 1.54 | 1.826 | 3.57 | 0.333 |
| 369_C10 | 2.48 | 2.456 | 3.373 | 0.32 |
| 367_F05 | 2.269 | 2.485 | 3.44 | 0.386 |
| 365_C07 | 1.943 | 1.917 | 3.171 | 0.311 |
| 374_C08 | 3.295 | 3.417 | 3.178 | 0.178 |
| 376_A06 | 3.694 | 3.742 | 3.162 | 0.262 |
| 376_B07 | 3.732 | 3.714 | 3.526 | 0.234 |
| 365_F07 | 3.122 | 3.184 | 3.393 | 0.331 |
| 369_E10 | 3.36 | 3.534 | 3.594 | 0.412 |
| 373_E03 | 3.465 | 3.465 | 3.247 | 0.194 |
| 366_B04 | 2.805 | 3.046 | 3.397 | 0.331 |
| 376_F12 | 3.131 | 3.247 | 3.441 | 0.323 |
| 369_F07 | 3.431 | 3.43 | 3.47 | 0.335 |
| 368_C06 | 0.738 | 1.034 | 3.524 | 0.255 |
| 376_E12 | 3.61 | 3.316 | 3.416 | 0.306 |
| 371_H01 | 3.027 | 2.995 | 3.693 | 0.471 |
| 367_E02 | 1.871 | 2.026 | 3.438 | 0.37 |
| 365_F04 | 2.26 | 2.509 | 3.471 | 0.403 |
| 370_A09 | 3.461 | 3.269 | 3.576 | 0.361 |
| 365_B03 | 2.645 | 2.53 | 3.377 | 0.444 |
| 369_A05 | 3.285 | 3.25 | 3.48 | 0.588 |
| 373_H10 | 3.243 | 3.251 | 3.189 | 0.2 |
| 367_A09 | 2.178 | 2.41 | 3.454 | 0.259 |
| 370_F08 | 2.339 | 2.994 | 3.587 | 0.495 |
| 376_B01 | 3.278 | 3.67 | 3.242 | 0.308 |
| 365_D05 | 2.578 | 2.72 | 3.514 | 0.357 |
| 373_E04 | 3.556 | 3.546 | 3.301 | 0.251 |
| 368_G05 | 2.175 | 2.421 | 3.354 | 0.245 |
| 365_A01 | 2.765 | 2.9 | 3.508 | 0.528 |
| 373_H06 | 3.004 | 3.151 | 3.3 | 0.2 |
| 369_G07 | 3.322 | 3.369 | 2.976 | 0.32 |
| 373_G05 | 3.612 | 3.615 | 3.224 | 0.273 |
| 372_F07 | 3.248 | 3.241 | 3.401 | 0.296 |
| 370_H03 | 3.426 | 3.565 | 3.558 | 0.381 |
| 366_A03 | 1.152 | 1.119 | 3.314 | 0.303 |
| 365_A07 | 2.244 | 2.255 | 3.407 | 0.284 |
| 376_B06 | 3.697 | 3.773 | 3.457 | 0.222 |
| 374_C11 | 3.641 | 3.593 | 3.215 | 0.471 |
| 375_A06 | 3.653 | 3.707 | 3.114 | 0.298 |
| 365_B09 | 3.264 | 3.319 | 3.282 | 0.272 |
| 373_E06 | 3.706 | 3.639 | 3.221 | 0.187 |
| 374_C05 | 3.698 | 3.693 | 3.176 | 0.175 |
| 376_C11 | 3.704 | 3.626 | 3.46 | 0.23 |
| 373_C09 | 3.64 | 3.597 | 3.22 | 0.17 |
| 368_H01 | 3.027 | 3.142 | 3.693 | 0.374 |
| 373_B03 | 3.638 | 3.621 | 3.161 | 0.18 |
| 374_C04 | 3.741 | 3.741 | 3.166 | 0.201 |
| 371_F05 | 2.89 | 3.149 | 3.33 | 0.297 |
| 369_A10 | 3.375 | 3.139 | 3.414 | 0.348 |
| 366_A05 | 2.624 | 2.596 | 3.477 | 0.284 |
| 375_G07 | 3.633 | 3.672 | 3.197 | 0.178 |
| 374_D02 | 3.06 | 3.2 | 2.994 | 0.204 |
| 365_A10 | 2.185 | 2.492 | 3.451 | 0.293 |
| 375_A02 | 2.977 | 3.178 | 3.066 | 0.186 |
| 371_G03 | 3.121 | 3.267 | 3.593 | 0.359 |
| 370_E07 | 3.442 | 3.496 | 3.453 | 0.379 |
| 375_B04 | 3.693 | 3.73 | 3.259 | 0.19 |
| 367_G07 | 3.019 | 3.197 | 3.287 | 0.295 |
| 366_C02 | 3.033 | 3.04 | 3.43 | 0.341 |
| 375_C12 | 3.662 | 3.328 | 3.266 | 0.197 |
| 365_F08 | 2.246 | 2.611 | 3.626 | 0.437 |
| 368_G09 | 2.438 | 2.815 | 3.62 | 0.281 |
| 368_E11 | 2.573 | 2.923 | 3.73 | 0.341 |
| 367_F02 | 2.375 | 2.268 | 3.522 | 0.315 |
| 373_B08 | 3.698 | 3.663 | 3.218 | 0.17 |
| 374_A11 | 3.645 | 3.722 | 2.806 | 0.15 |
| 373_B11 | 3.719 | 3.652 | 3.217 | 0.178 |
| 373_F03 | 3.652 | 3.603 | 3.213 | 0.179 |
| 372_D04 | 3.401 | 3.408 | 3.384 | 0.419 |
| 366_C01 | 2.307 | 2.406 | 3.601 | 0.382 |
| 367_A01 | 3.182 | 3.284 | 3.51 | 0.391 |
| 366_H05 | 2.445 | 2.737 | 3.47 | 0.418 |
| 369_B09 | 1.624 | 1.577 | 2.216 | 0.253 |
| 366_D07 | 2.413 | 2.623 | 3.383 | 0.418 |
| 369_D11 | 2.988 | 2.99 | 3.454 | 0.35 |
| 370_B05 | 2.839 | 3.111 | 3.492 | 0.593 |
| 366_D02 | 2.274 | 2.549 | 3.567 | 0.349 |
| 368_H12 | 2.636 | 2.693 | 3.572 | 0.381 |
| 368_F12 | 1.689 | 1.702 | 3.515 | 0.349 |
| 370_A06 | 2.594 | 2.769 | 3.471 | 0.331 |
| 369_F12 | 2.732 | 2.819 | 3.596 | 0.434 |
| 366_A09 | 1.787 | 1.926 | 3.277 | 0.266 |
| 368_H07 | 2.707 | 2.864 | 3.553 | 0.421 |
| 370_C04 | 2.319 | 2.632 | 3.6 | 0.334 |
| 373_E02 | 3.612 | 3.643 | 2.921 | 0.158 |
| 374_E09 | 3.671 | 3.578 | 3.157 | 0.162 |
| 371_C09 | 3.369 | 3.289 | 3.393 | 0.308 |
| 369_B12 | 2.666 | 2.759 | 3.562 | 0.4 |
| 369_B02 | 3.4 | 3.546 | 3.522 | 0.456 |
| 365_C09 | 2.052 | 2.178 | 3.272 | 0.266 |
| 374_B09 | 3.621 | 3.652 | 3.194 | 0.172 |
| 374_D12 | 3.55 | 3.28 | 3.087 | 0.235 |
| 374_C02 | 3.676 | 3.64 | 3.059 | 0.167 |
| 374_H08 | 3.307 | 3.271 | 3.089 | 0.199 |
| 369_D06 | 3.438 | 3.346 | 3.11 | 0.324 |
| 366_B06 | 2.474 | 2.453 | 3.104 | 0.415 |
| 367_A11 | 2.344 | 2.521 | 3.611 | 0.3 |
| 369_F04 | 1.949 | 2.171 | 3.459 | 0.369 |
| 369_A01 | 3.6 | 3.66 | 3.546 | 0.456 |
| 373_H12 | 3.061 | 2.985 | 3.004 | 0.162 |
| 376_C07 | 3.697 | 3.714 | 3.419 | 0.265 |
| 366_E02 | 2.257 | 2.581 | 3.456 | 0.37 |
| 376_G01 | 3.341 | 3.663 | 3.18 | 0.227 |
| 373_F02 | 3.623 | 3.6 | 3.149 | 0.175 |
| 376_E09 | 3.741 | 3.76 | 3.483 | 0.246 |
| 365_H04 | 2.471 | 2.588 | 3.495 | 0.371 |
| 369_E04 | 2.883 | 3.304 | 3.516 | 0.387 |
| 374_B11 | 3.692 | 3.657 | 3.175 | 0.17 |
| 376_G11 | 3.646 | 3.604 | 3.538 | 0.285 |
| 374_E04 | 3.74 | 3.716 | 3.187 | 0.169 |
| 373_E08 | 2.966 | 3.235 | 3.199 | 0.165 |
| 375_B10 | 3.651 | 3.74 | 3.138 | 0.17 |
| 365_E08 | 2.591 | 2.585 | 3.331 | 0.298 |
| 374_G02 | 3.515 | 3.538 | 3.174 | 0.175 |
| 373_D09 | 3.463 | 3.505 | 3.043 | 0.16 |
| 365_A04 | 1.487 | 1.405 | 3.28 | 0.25 |
| 371_B05 | 1.051 | 1.243 | 1.653 | 0.246 |
| 376_H08 | 3.305 | 3.279 | 3.527 | 0.274 |
| 367_G08 | 2.686 | 2.779 | 3.319 | 0.33 |
| 372_H03 | 2.322 | 2.697 | 3.642 | 0.437 |
| 366_E03 | 2.551 | 2.724 | 3.536 | 0.384 |
| 371_F12 | 2.474 | 2.304 | 3.616 | 0.413 |
| 366_C03 | 2.414 | 2.736 | 3.549 | 0.274 |
| 376_A01 | 3.243 | 3.661 | 2.985 | 0.239 |
| 365_E03 | 2.559 | 2.692 | 3.332 | 0.314 |
| 371_B10 | 3.313 | 3.36 | 3.441 | 0.387 |
| 369_G09 | 3.36 | 3.269 | 3.605 | 0.395 |
| 369_A06 | 2.891 | 3.012 | 3.32 | 0.394 |
| 369_C08 | 2.32 | 2.325 | 2.797 | 0.241 |

TABLE 4-continued

| Ab | Human ACVR2A | Mouse ACVR2A | Goat anti-Human Kappa | Human Fc |
|---|---|---|---|---|
| 373_A07 | 3.525 | 3.594 | 3.114 | 0.177 |
| 367_D02 | 2.464 | 2.464 | 3.462 | 0.321 |
| 374_C07 | 3.651 | 3.698 | 3.22 | 0.225 |
| 374_A03 | 3.58 | 3.71 | 3.05 | 0.178 |
| 365_A02 | 3.028 | 2.962 | 3.492 | 0.374 |
| 365_D06 | 2.953 | 3.075 | 3.421 | 0.319 |
| 366_C07 | 3.016 | 3.06 | 3.368 | 0.301 |
| 367_F12 | 2.38 | 2.285 | 3.599 | 0.355 |
| 369_E09 | 3.627 | 3.767 | 3.483 | 0.278 |
| 365_G02 | 1.984 | 2.155 | 3.447 | 0.325 |
| 373_D02 | 3.729 | 3.645 | 3.187 | 0.18 |
| 374_E03 | 3.716 | 3.789 | 3.127 | 0.176 |
| 374_D11 | 3.639 | 3.579 | 2.905 | 0.162 |
| 370_D07 | 2.806 | 3.141 | 3.384 | 0.309 |
| 374_A08 | 3.589 | 3.673 | 2.944 | 0.16 |
| 374_G01 | 3.344 | 3.595 | 2.922 | 0.161 |
| 374_G12 | 3.195 | 3.215 | 3.149 | 0.214 |
| 375_G10 | 3.481 | 3.639 | 3.302 | 0.175 |
| 369_H11 | 1.445 | 1.639 | 2.21 | 0.382 |
| 375_G12 | 3.356 | 3.29 | 3.304 | 0.199 |
| 366_F06 | 1.874 | 2.155 | 3.445 | 0.394 |
| 368_G07 | 1.788 | 2.048 | 3.164 | 0.29 |
| 367_H04 | 1.623 | 1.849 | 3.395 | 0.289 |
| 374_E06 | 3.844 | 3.755 | 3.245 | 0.191 |
| 370_A10 | 2.581 | 2.878 | 3.467 | 0.434 |
| 368_H10 | 2.281 | 2.156 | 3.359 | 0.281 |
| 368_G08 | 1.603 | 1.752 | 3.291 | 0.329 |
| 365_H09 | 2.384 | 2.563 | 3.53 | 0.365 |
| 370_A08 | 2.406 | 2.335 | 3.522 | 0.319 |
| 368_B05 | 1.732 | 1.755 | 3.257 | 0.281 |
| 375_F01 | 3.16 | 3.455 | 2.956 | 0.166 |
| 374_F09 | 3.533 | 3.617 | 3.142 | 0.157 |

Example 3

Ligand Competition Assays

The ability of several of the antibodies identified in Example 2 to block Activin A and GDF8 binding to ACVR2A or ACVR2B was assessed by ELISA. Activin A (R&D systems) and GDF8 (R&D systems) were coated on 384-well Immunolon plates in 1× coating buffer (SurModics) at 0.5 µg/mL. Antibodies were serially diluted in a 10-point curve starting at 1 µM in 3-fold steps. ACVR2A and ACVR2B proteins were purchased from R&D Systems and biotinylated using the EZ-Link NHS-PEG4-biotin kit (Thermo Fisher). The antibodies were pre-incubated with biotinylated human ACVR2A-Fc, mouse ACVR2A-Fc, human ACVR2B-Fc, or mouse ACVR2B-Fc at a concentration of 500 ng/mL in 1% BSA in PBST for 1 hour. The mixtures of antibodies and biotinylated receptors were added to the Activin A/GDF8-coated plates for 1 hour. The inhibition of ligand-receptor interaction was detected with streptavidin-HRP (Jackson ImmunoResearch) at a concentration of 10 ng/mL and TMB.

The results of this assay are shown in columns A-D of Table 5 below. The values shown are IC50 values. The data in this table shows that the antibodies can specifically block Activin A and GDF8 binding to ACVR2A.

Example 4

Alk5/Acvr2B Dimerization Assay

The ability of several of the antibodies identified in Example 2 to specifically block GDF8-induced dimerization between ACVR2A and ALK5 in U2OS cells was assessed using the DiscoverX receptor dimerization assay. In these assays, two receptors are tagged with ProLink™ (PK) or Enzyme Acceptor (EA). Upon ligand-induced activation, the receptors dimerize forcing the two β-gal components to complement and create an active enzyme. Active β-gal generates a chemiluminescent signal in the presence of substrate. In these assays, approximately 5000 U2OS cells were transferred into each well in total volume of 20 ul, antibody was dispensed into each well in total volume of 5 ul, the treated cells were incubated for 3 hr at 37° C., 5 ul of GDF8 was dispensed into wells in total volume of 5 ul (final conc 100 ng/ml), the cells were incubated for 16 hr at 37° C. and 30 ul of 1× Flash detection reagent was added to each well. The reactions were incubated for 1 hr at room temperature and then read on a plate reader.

The results of this assay are shown in columns E and F of Table 5 below. The values shown are IC50 values. The data in this table shows that the antibodies block GDF8-induced dimerization of ALK5/ACVR2A but not ALK5/ACVR2B.

Example 5

Quantitative ELISA Assays

The binding of several of the antibodies identified in Example 2 to human ACVR2A, mouse ACVR2A, human ACVR2B, and mouse ACVR2B were quantified by ELISA. His-tagged recombinant proteins (Sino Biological, Inc.) were His-tagged Human ACVR2A, Mouse ACVR2A, Human ACVR2B, or Mouse ACVR2B were coated on Immunolon 384-well plates at a concentration of 0.5 µg/mL in 1× coating buffer (SurModics). Antibodies were diluted to 1 µM in PBS buffer containing 1% BSA and diluted 3-fold in a 10-point curve. Detection of the antibody binding to the antigen was performed using biotinylated goat anti-human kappa light chain (Bethyl Laboratories). Detection of the secondary antibody was determined using streptavidin-HRP and TMB reagent. All assays were performed at room temperature. Curve-fitting software was used to determine the EC50 for each antibody (MatLab).

The results of this assay are shown in columns G-L of Table 5 below. The values shown are EC50 values. The data in this table shows that the antibodies specifically bind to ACVR2A, not ACVR2B.

Example 6

Activity on Skeletal Muscle Cells

The ability of several of the antibodies identified in Example 2 to alter SMAD3 activity in muscle cells was tested. Primary human myoblasts (Lonza) cultured in Ham's F-10 supplemented with SkGM-2 Single-Quots (Lonza). Myoblasts were differentiated in DMEM/F-12K (50:50) supplemented with 2% horse serum (Corning) and 1% Penicillin/Streptomycin. After 4 days of differentiation, myotubes were pre-treated with antibodies for 1 hour at a starting concentration of 1 µM and diluted serially 3-fold in a 10-point curve. GDF8 (R&D) was added for 1 hour at 100 ng/mL. Cells were lysed in 30 µL of PBS+0.1% Triton-X+ 1× Halt Protease/Phosphastase inhibitors (Thermo Fisher). Phospho-SMAD3 (Ser423/425) activity was assessed in primary human myotubes by AlphaLisa (Perkin-Elmer) according to manufacturer's instructions.

The results of this assay are shown in column M of Table 5 below. The data in this table shows that the antibodies reduce GDF8-induced SMAD3 phosphorylation in muscle cells.

Example 7

SMAD Reporter 293 Assay

The ability of several of the antibodies identified in Example 2 to specifically inhibit GDF8-induced SMAD activation in HEK293 was tested cells using a smad2/3 luciferase reporter construct. In these experiments, a smad2/3 luciferase reporter (SBI #TR203VA-P) was introduced into HEK293 cells. Endogenous ACVR2A and ACVR2B function was knocked out using custom made CRISPR/CAS9 targeting sequences. Finally, individual reporter lines were generated by reintroduction of ACVR2A or ACVR2B expression vectors. This method involved dispensing 30,000 cells into each well in total volume of 80 ul, dispensing antibody into each well in total volume of 10 ul, incubating the treated cells for 1 hr at 37° C., dispensing GDF8 into wells in total volume of 10 ul (final conc. 100 ng/ml), incubating the stimulated cells for 24 hr at 37° C., adding 100 ul of 1× ONE-Glo detection reagent to each well, incubate the plate for 5 min at room temperature and then reading luminescence using a plate reader.

The results of this assay are shown in column N of Table 5 below. The values shown are IC50 values. The data in this table shows that the antibodies inhibit GDF8-induced SMAD3 phosphorylation in HEK293 cells.

Example 8

SMAD Reporter 4E1 Assay

The ability of several of the antibodies identified in Example 2 to specifically inhibit GDF8-induced SMAD activation was tested cells using the following protocol. In this assay, HEK293 cells were infected with a lentiviral SMAD2/3/4 reporter (pGF-SMAD2/3/4-mCMV-EF1-Puro System Biosciences). The lentiviral based reporter expresses both GFP and luciferase under the control of a Smad3-responsive element $(CAGA)_{12}$. Cells were sorted for their responsiveness to GDF8 based on their GFP expression. Single cell clones were expanded and transcriptional activation was tested by GDF8-induced luciferase activity. Clone 4E1 was unresponsive to GDF8 or Activin A. This clone was further transfected with Human or Mouse ACVR2A or ACVR2B plasmids. The ability of the antibodies to inhibit luciferase induction by GDF8 or Activin A in these cell lines was tested.

The results of this assay are shown in column 0 of Table 5 below. These values are IC50 values. The data in this table shows that the antibodies inhibit GDF8 and Activin A-mediated induction of SMAD2/3/4 in HEK293 cells.

TABLE 5

| Ab | A Comp ELISA Human ACVR2A Activin A | B Comp ELISA Human ACVR2A GDF8 | C Comp ELISA Mouse ACVR2A Activin A | D Comp ELISA Mouse ACVR2A GDF8 | E Dimer ALK5/ ACVR2A GDF8 | F Dimer ALK5/ ACVR2B GDF8 | G ELISA Human ACVR2A (10 pt) | H ELISA- Human ACVR2A (8 pt) |
|---|---|---|---|---|---|---|---|---|
| 365_B10 | 0.0189 | 0.0009 | 0.0066 | 0.0002 | 0.6247 | 9999 | 0.0013 | 0.001 |
| 365_E04 | | | | | | | | 0.004 |
| 365_H08 | 0.4151 | 0.0116 | 0.1949 | 0.0044 | 9999 | 9999 | 0.1963 | 0.0089 |
| 366_D01 | 0.338 | 0.0292 | 0.2896 | 0.0133 | 6.372 | 9999 | 0.0017 | |
| 366_G06 | | | | | | | | 0.0059 |
| 367_H01 | 0.0363 | 0.0035 | 0.0125 | 0.0014 | 6.578 | 9999 | 0.0064 | 0.0009 |
| 368_A02 | | | | | | | | 0.008 |
| 368_A12 | 0.081 | 0.002 | 0.0348 | 0.0007 | 2.303 | 9999 | 0.0016 | 0.0028 |
| 368_B10 | 0.0077 | 0.0025 | 0.0084 | 0.0032 | 0.4969 | 9999 | 0.0053 | 0.0048 |
| 368_F10 | 0.1033 | 0.0069 | 0.1028 | 0.004 | 3.946 | 9999 | 0.0039 | |
| 369_B03 | 0.0164 | 0.0044 | 0.0115 | 0.0033 | 1.761 | 9999 | 0.0051 | 0.0031 |
| 369_H03 | 0.1782 | 0.0017 | 0.0246 | 0.0001 | 8.179 | 9999 | 0.0073 | 0.003 |
| 370_B01 | 0.0036 | 0.0006 | 0.0027 | 0.0004 | 0.1589 | 9999 | 0.0004 | 0.0011 |
| 371_D07 | 0.0271 | 0.0032 | 0.0344 | 0.0035 | 1.182 | 9999 | 0.0093 | 0.013 |
| 372_B11 | 0.0623 | 0.0059 | 0.0718 | 7.11E−05 | 2.191 | 9999 | 0.0042 | |
| 373_E11 | 0.0208 | 0.0012 | 0.021 | 8.31E−05 | 0.9392 | 9999 | 0.0013 | |
| 373_H02 | 0.01 | 0.0036 | 0.005 | 0.0032 | 0.7633 | 9999 | 0.0032 | 0.001 |
| 374_B02 | 0.1374 | 0.0206 | 0.0771 | 0.0112 | 5.938 | 9999 | 0.0653 | 0.01 |
| 375_A04 | 0.0025 | 0.0015 | 0.0018 | 0.0011 | 0.0481 | 9999 | 0.0007 | 0.0006 |
| 375_A11 | 0.0167 | 0.0082 | 0.0105 | 0.0047 | 0.939 | 9999 | 0.0047 | 0.0009 |
| 375_H01 | | | | | | | | 0.015 |
| 376_G02 | 0.0144 | 0.0051 | 0.0111 | 0.0041 | 0.8281 | 9999 | 0.0029 | 0.0018 |
| 365_G06 | 0.0151 | 0.0034 | 0.0225 | 0.0028 | 0.4743 | 9999 | 0.0035 | 0.0026 |
| 367_F10 | 0.0186 | 0.0035 | 0.0168 | 0.0026 | 2.249 | 9999 | 0.0019 | 0.0136 |
| 368_B12 | 0.0074 | 0.0035 | 0.0128 | 0.0033 | 0.4249 | 9999 | 0.0047 | 0.0058 |
| 369_A12 | 0.0205 | 0.0005 | 0.0119 | 0.0002 | 0.3311 | 9999 | 0.001 | 0.0017 |
| 369_E03 | 0.0777 | 0.0006 | 0.0345 | 0.0049 | 0.8456 | 9999 | 0.001 | 0.0059 |
| 370_B06 | 0.018 | 0.0007 | 0.0107 | 0.0002 | 0.9481 | 9999 | 0.0032 | 0.0018 |
| 371_B11 | 0.0268 | 0.0038 | 0.0147 | 0.157 | 0.5699 | 9999 | 0.0011 | 0.0012 |
| 371_C02 | 0.0519 | 0.0043 | 0.0577 | 0.0087 | 3.394 | 9999 | 0.0025 | 0.0045 |
| 373_D11 | 0.0037 | 0.0005 | 0.004 | 0.0001 | 0.1968 | 9999 | 0.0003 | |
| 373_G05 | 0.0478 | 0.0053 | 0.0325 | 0.0044 | 9999 | 9999 | 0.0052 | 0.0009 |
| 376_D08 | 0.0027 | 0.0007 | 0.0019 | 0.0007 | 0.075 | 9999 | 0.0005 | |
| 376_F09 | 0.0094 | 0.0015 | 0.0101 | 0.0016 | 0.3541 | 9999 | 0.0045 | 0.0046 |
| 365_E12 | | | | | | | | 0.0019 |
| 365_F02 | 0.0077 | 0.0022 | 0.0078 | 0.0014 | 0.2793 | 9999 | 0.0005 | 0.0005 |
| 365_G05 | | | | | | | | 0.0073 |

TABLE 5-continued

| | | | | | | | | |
|---|---|---|---|---|---|---|---|---|
| 367_A03 | | | | | | | | 0.0136 |
| 367_C07 | 0.0298 | 0.0042 | 0.03 | 0.0041 | 1.082 | 9999 | 0.0008 | |
| 369_A07 | 0.0056 | 0.0039 | 0.0029 | 0.0013 | 0.5726 | 9999 | 0.001 | 0.0005 |
| 369_B05 | | | | | | | | 0.0027 |
| 370_A02 | | | | | | | | 0.0022 |
| 370_H02 | 0.0254 | 0.0005 | 0.0123 | 1.00E−14 | 0.9495 | 9999 | 0.0009 | 0.0016 |
| 371_A10 | | | | | | | | 0.0058 |
| 371_C12 | 0.043 | 0.0004 | 0.024 | 0.0043 | 0.3095 | 9999 | 0.0006 | 0.0011 |
| 371_D02 | | | | | | | | 0.0028 |
| 371_G09 | | | | | | | | 0.0019 |
| 371_G11 | 0.0052 | 0.0004 | 0.0066 | 0.0045 | 7.363 | 9999 | 0.0042 | 0.0039 |
| 372_B02 | 0.0099 | 0.0001 | 0.0045 | 0.0004 | 2.192 | 9999 | 0.0019 | 0.0026 |
| 372_D03 | 0.003 | 0.0004 | 0.0013 | 0.0006 | 0.7064 | 9999 | 0.0011 | 0.0012 |
| 373_A03 | 0.0053 | 0.0023 | 0.0031 | 0.0021 | 0.2914 | 9999 | 0.001 | 0.001 |
| 373_A05 | | | | | | | | 0.0032 |
| 373_A09 | | | | | | | | 0.0012 |
| 373_A11 | | | | | | | | 0.0009 |
| 373_B05 | | | | | | | | 0.0022 |
| 373_C07 | 0.0126 | 0.004 | 0.0087 | 0.0011 | 1.215 | 9999 | 0.0028 | 0.0015 |
| 373_F08 | 0.0022 | 0.0015 | 0.0017 | 0.0004 | 0.0919 | 9999 | 0.0006 | 0.0007 |
| 373_F12 | | | | | | | | 0.0016 |
| 373_G08 | 0.0041 | 0.0012 | 0.0033 | 0.001 | 0.2649 | 9999 | 0.0009 | 0.001 |
| 373_H03 | 0.0199 | 0.0074 | 0.0117 | 0.0056 | 2.093 | 9999 | 0.003 | |
| 374_B03 | 0.0031 | 0.0015 | 0.002 | 0.0005 | 0.2057 | 9999 | 0.0008 | 0.0009 |
| 374_C01 | 0.3127 | 0.0191 | 0.2885 | 0.0033 | 9999 | 9999 | 0.022 | |
| 374_C09 | 0.0457 | 0.0088 | 0.0495 | 0.0047 | 1.402 | 9999 | 0.011 | 0 |
| 374_C12 | 0.0045 | 0.0023 | 0.0038 | 0.0025 | 0.2619 | 9999 | 0.0016 | 0.0005 |
| 374_D05 | 0.0392 | 0.0065 | 0.0258 | 0.0068 | 1.646 | 9999 | 0.0074 | 0.0022 |
| 374_D10 | 0.0781 | 0.0038 | 0.0853 | 0.0027 | 3.185 | 9999 | 0.0032 | |
| 374_G08 | 0.0056 | 0.0025 | 0.0056 | 0.0017 | 0.608 | 9999 | 0.0018 | 0.0009 |
| 375_A01 | | | | | | | | 0.0012 |
| 375_A07 | 0.0097 | 0.0025 | 0.0221 | 0.0025 | 0.4117 | 9999 | 0.001 | |
| 375_A12 | 0.0047 | 0.0011 | 0.0033 | 0.0003 | 0.3345 | 9999 | 0.0007 | |
| 375_D10 | | | | | | | | 0.0023 |
| 375_E05 | | | | | | | | 0.0009 |
| 375_E10 | 0.0035 | 0.002 | 0.0023 | 0.0009 | 0.2255 | 9999 | 0.0007 | 0.0008 |
| 375_F02 | 0.0288 | 0.0034 | 0.0184 | 0.006 | 0.8957 | 9999 | 0.0037 | |
| 375_G05 | 0.0008 | 0.0005 | 0.001 | 0.0004 | 0.1347 | 9999 | 0.0005 | 0.0007 |
| 375_H05 | 0.0057 | 0.0019 | 0.0043 | 9.34E−05 | 0.4237 | 9999 | 0.0008 | 0.0006 |
| 376_A03 | | | | | | | | 0.0022 |
| 376_B10 | | | | | | | | 0.0021 |
| 376_C08 | 0.0243 | 0.0046 | 0.0272 | 0.0046 | 0.9254 | 9999 | 0.0044 | |
| 376_F01 | 0.1328 | 0.0177 | 0.1264 | 0.0117 | 2.893 | 9999 | 0.0076 | 0.0082 |
| 376_F06 | 0.0352 | 0.0032 | 0.021 | 0.002 | 0.5714 | 9999 | 0.0034 | 0.0024 |
| 376_G05 | 0.0081 | 0.0036 | 0.008 | 0.0032 | 0.9329 | 9999 | 0.0017 | 0.0005 |
| 376_G10 | | | | | | | | 0.0031 |
| 376_H01 | 0.005 | 0.0025 | 0.0044 | 0.0013 | 0.5641 | 9999 | 0.001 | 0.0012 |
| 375_H11 | 0.0008 | 0.0007 | 0.0013 | 0.0007 | 0.0368 | 9999 | 0.0004 | 0.0005 |
| 367_A02 | 0.0685 | 0.0168 | 0.0757 | 0.0117 | 1.404 | 9999 | 0.0099 | |
| 368_G03 | 0.1025 | 0.0013 | 0.0477 | 0.0003 | 6.011 | 9999 | 0.0033 | 0.0066 |
| 368_H06 | | | | | | | | 0.0138 |
| 369_C12 | 0.0022 | 0.0007 | 0.0016 | 0.0006 | 0.137 | 9999 | 0.0007 | 0.0008 |
| 369_E08 | | | | | | | | 0.0028 |
| 369_F09 | 0.0204 | 0.0007 | 0.0196 | 0.0004 | 0.793 | 9999 | 0.0012 | |
| 369_H08 | 0.0721 | 0.0014 | 0.0431 | 0.0002 | 1.385 | 9999 | 0.0013 | 0.0034 |
| 369_H12 | 0.0154 | 0.001 | 0.0112 | 0.0001 | 1.812 | 9999 | 0.0005 | 0.0011 |
| 370_C06 | 0.0148 | 0.0005 | 0.0083 | 6.83E−05 | 0.7631 | 9999 | 0.0005 | 0.0009 |
| 370_C07 | 0.0219 | 0.0011 | 0.0084 | 0.0006 | 0.3774 | 9999 | 0.0005 | 0.0008 |
| 370_D03 | 0.0163 | 0.0025 | 0.0103 | 0.0042 | 0.8872 | 9999 | 0.0023 | 0.0017 |
| 370_E04 | 0.0067 | 0.0023 | 0.0065 | 0.0005 | 0.8152 | 9999 | 0.0008 | 0.0007 |
| 370_F12 | 0.005 | 0.0002 | 0.0025 | 2.65E−05 | 0.3859 | 9999 | 0.0009 | 0.0006 |
| 371_B02 | 0.003 | 0.0006 | 0.0024 | 0.0002 | 0.1059 | 9999 | 0.0005 | 0.0017 |
| 371_E12 | 0.0023 | 0.0043 | 0.0022 | 0.0024 | 0.5962 | 9999 | 0.0012 | |
| 371_F09 | 0.0054 | 0.0006 | 0.0047 | 0.0003 | 0.2882 | 9999 | 0.0006 | |
| 371_G01 | | | | | | | | 0.0013 |
| 371_H11 | | | | | | | | 0.0011 |
| 372_B09 | 0.0022 | 0.0002 | 0.0007 | 0.0003 | 0.6034 | 9999 | 0.0006 | 0.0009 |
| 373_D06 | 0.0085 | 0.001 | 0.0083 | 0.0003 | 0.3887 | 9999 | 0.0004 | |
| 373_F07 | 0.0091 | 0.002 | 0.0056 | 0.0039 | 3.811 | 9999 | 0.0015 | |
| 374_A05 | 0.0023 | 0.0002 | 0.0011 | 0.0005 | 0.0998 | 9999 | 0.0003 | 0.0008 |
| 374_C10 | 0.0137 | 0.003 | 0.0064 | 0.0023 | 0.4673 | 9999 | 0.001 | 0.0013 |
| 374_G05 | 0.0074 | 0.002 | 0.0042 | 0.0027 | 0.5471 | 9999 | 0.0022 | 0.0006 |
| 365_A12 | 0.3112 | 0.0015 | 0.1194 | 5.64E−05 | 9999 | 9999 | 0.0103 | 0.0084 |
| 365_B11 | | | | | | | | 0.003 |
| 365_E05 | 0.0435 | 0.0098 | 0.0528 | 0.0071 | 0.8445 | 9999 | 0.0045 | |
| 365_E07 | 0.3702 | 0.0105 | 0.1501 | 0.0122 | 9999 | 9999 | 0.011 | 0.008 |
| 365_B12 | 0.0304 | 0.0115 | 0.0185 | 0.0114 | 0.8558 | 9999 | 0.0012 | 0.0013 |
| 367_F03 | | | | | | | | 0.01 |
| 367_H06 | 0.0744 | 0.0035 | 0.0653 | 0.0034 | 0.8666 | 9999 | 0.0018 | |
| 367_H11 | 0.0389 | 0.0044 | 0.0258 | 0.0035 | 0.4515 | 9999 | 0.0057 | 0.004 |

TABLE 5-continued

| | | | | | | | | |
|---|---|---|---|---|---|---|---|---|
| 368_F03 | 0.4171 | 0.0005 | 0.0323 | 0.0001 | 9999 | 9999 | 0.022 | 0.1 |
| 369_D02 | 0.0031 | 0.0006 | 0.0039 | 2.58E−05 | 0.2671 | 9999 | 0.0004 | |
| 369_F01 | 0.0147 | 0.0013 | 0.0147 | 0.0002 | 0.4998 | 9999 | 0.0008 | |
| 369_F06 | | | | | | | | 0.0038 |
| 369_G01 | 0.0112 | 0.0008 | 0.0061 | 0.0001 | 0.7538 | 9999 | 0.0004 | |
| 369_H06 | 0.0106 | 0.0028 | 0.0082 | 3.81E−05 | 9999 | 9999 | 0.0005 | 0.0004 |
| 370_A02 | | | | | | | | 0.0046 |
| 370_A12 | 0.0061 | 0.0023 | 0.0136 | 0.0024 | 0.1245 | 9999 | 0.0009 | 0.0018 |
| 370_C01 | | | | | | | | 0.0017 |
| 370_C03 | 0.0007 | 0.0004 | 0.0006 | 0.0004 | 0.0388 | 9999 | 0.0004 | 0.0003 |
| 370_C05 | 0.0053 | 0.0032 | 0.0036 | 0.0024 | 0.927 | 9999 | 0.0012 | 0.0033 |
| 370_C08 | | | | | | | | 0.0021 |
| 370_D04 | 0.0055 | 0.0012 | 0.0038 | 0.0013 | 0.1029 | 9999 | 0.0005 | 0.0007 |
| 370_E09 | 0.0043 | 0.0009 | 0.0021 | 0.0006 | 0.2656 | 9999 | 0.0006 | 0.0007 |
| 370_H01 | 0.0084 | 0.0006 | 0.0056 | 2.61E−05 | 2.84 | 9999 | 0.0005 | 0.0004 |
| 371_A05 | | | | | | | | 0.0014 |
| 371_B07 | 0.0161 | 0.0023 | 0.0155 | 0.0003 | 1.236 | 9999 | 0.0012 | 0.0014 |
| 371_F01 | | | | | | | | 0.005 |
| 371_F04 | | | | | | | | 0.0023 |
| 372_A04 | 0.0031 | 0.0028 | 0.0051 | 0.0022 | 0.3792 | 9999 | 0.0008 | |
| 372_D02 | | | | | | | | 0.0029 |
| 372_F03 | 0.0047 | 0.0005 | 0.0041 | 0.0002 | 0.1903 | 9999 | 0.0003 | 0.0008 |
| 372_F08 | 0.0031 | 0.0113 | 0.0026 | 0.0113 | 0.371 | 9999 | 0.0009 | |
| 372_F09 | 0.0053 | 0.0002 | 0.0113 | 0.0029 | 1.012 | 9999 | 0.001 | 0.0009 |
| 373_A10 | 0.0028 | 0.002 | 0.0055 | 0.0018 | 0.3578 | 2.53 | 0.0005 | |
| 373_B04 | 0.0186 | 0.0023 | 0.0103 | 0.0031 | 1.268 | 9999 | 0.0025 | 0.0018 |
| 373_C02 | 0.0302 | 0.0052 | 0.0179 | 0.0022 | 3.29 | 9999 | 0.0053 | |
| 373_C06 | | | | | | | | 0.001 |
| 373_D04 | 0.0019 | 0.0013 | 0.0023 | 0.0012 | 0.1467 | 9999 | 0.0006 | |
| 373_D10 | 0.0059 | 0.0018 | 0.0033 | 0.0004 | 0.2803 | 9999 | 0.0015 | 0.0008 |
| 374_B04 | 0.0043 | 0.0018 | 0.0029 | 0.0016 | 0.2473 | 9999 | 0.0014 | 0.0003 |
| 374_B06 | 0.0614 | 0.0041 | 0.0513 | 0.0001 | 0.5987 | 9999 | 0.0011 | 0.004 |
| 374_C03 | 0.0016 | 0.001 | 0.0026 | 0.0007 | 0.1284 | 9999 | 0.0005 | |
| 374_C06 | 0.0105 | 0.0039 | 0.0059 | 0.0032 | 0.5205 | 9999 | 0.0019 | 0.0008 |
| 374_D08 | 0.9536 | 0.0698 | 0.6104 | 0.0621 | 9999 | 9999 | 0.3558 | 0.01 |
| 374_E01 | | | | | | | | 0.0013 |
| 374_E05 | 0.0074 | 0.0023 | 0.0079 | 0.0019 | 0.3051 | 9999 | 0.0013 | 0.0016 |
| 365_E02 | 0.4962 | 0.0045 | 0.1618 | 0.0012 | 12.07 | 9999 | 0.0095 | 0.085 |
| 376_C06 | 0.0349 | 0.0049 | 0.0238 | 0.0053 | 0.711 | 9999 | 0.0042 | 0.0016 |
| 368_D10 | 0.0119 | 0.0045 | 0.0195 | 0.0033 | 0.4824 | 9999 | 0.0019 | |
| 374_C08 | 0.182 | 0.0325 | 0.194 | 0.0223 | 9999 | 9999 | 0.0452 | |
| 376_A06 | 0.0011 | 0.0006 | 0.0009 | 0.0004 | 0.0189 | 9999 | 0.0004 | 0.0084 |
| 365_F07 | 0.0044 | 0.0017 | 0.0037 | 0.0006 | 0.135 | 9999 | 0.0012 | 0.0006 |
| 376_B01 | 0.0035 | 0.0006 | 0.0039 | 8.50E−05 | 0.2036 | 9999 | 0.0004 | |
| 365_D05 | 0.0146 | 0.0025 | 0.0149 | 0.0009 | 0.9169 | 9999 | 0.0008 | |
| 369_G07 | 0.0068 | 0.001 | 0.0075 | 0.0001 | 9999 | 9999 | 0.0007 | |
| 373_G05 | 0.0023 | 0.0002 | 0.0021 | 0.0002 | 0.1636 | 9999 | 0.0003 | |
| 376_B06 | 0.0016 | 0.001 | 0.0014 | 0.0007 | 0.0381 | 9999 | 0.0005 | 0.0006 |
| 374_C11 | 0.0192 | 0.0015 | 0.0105 | 0.0034 | 0.9402 | 9999 | 0.0018 | |
| 375_A06 | 0.0032 | 0.0016 | 0.0025 | 0.0013 | 0.1302 | 9999 | 0.0012 | 0.0005 |
| 373_E06 | 0.0002 | 0.0002 | 0.0002 | 0.0001 | 0.0082 | 9999 | 0.0002 | 0.0002 |
| 374_C05 | 0.0009 | 0.0005 | 0.0011 | 0.0004 | 0.1344 | 9999 | 0.0007 | 0.0005 |
| 368_H01 | | | | | | | | 0.0017 |
| 373_B03 | | | | | | | | 0.0006 |
| 369_A10 | 0.017 | 0.0005 | 0.0077 | 8.47E−05 | 5000 | 9999 | 0.001 | 0.0015 |
| 366_A05 | | | | | 0.7418 | 9999 | 0.0004 | 0.0006 |
| 375_G07 | 0.0085 | 0.0032 | 0.0053 | 0.0031 | 0.7814 | 9999 | 0.0022 | 0.0012 |
| 371_G03 | | | | | | | | 0.001 |
| 370_E07 | 0.0009 | 0.0005 | 0.0013 | 0.0005 | 0.1001 | 9999 | 0.0007 | 0.0003 |
| 367_G07 | 0.0007 | 0.0009 | 0.0011 | 0.0007 | 0.1113 | 9999 | 0.0011 | 0.0005 |
| 375_C12 | 0.0006 | 0.0003 | 0.0007 | 0.0004 | 0.0414 | 9999 | 0.0004 | 0.0003 |
| 373_B08 | 0.003 | 0.0012 | 0.002 | 0.0012 | 0.3478 | 9999 | 0.0015 | 0.0005 |
| 374_A11 | 0.0038 | 0.0015 | 0.0027 | 0.0015 | 0.6038 | 9999 | 0.0013 | 0.0004 |
| 373_B11 | 0.0003 | 0.0002 | 0.0005 | 0.0003 | 0.0185 | 9999 | 0.0002 | |
| 372_D04 | 0.0022 | 0.0008 | 0.0026 | 0.0317 | 0.1255 | 9999 | 0.0009 | 0.0005 |
| 367_A01 | 0.0021 | 0.0009 | 0.0041 | 0.0011 | 0.1471 | 9999 | 0.0012 | 0.0009 |
| 373_E02 | 0.0034 | 0.0013 | 0.0021 | 0.0013 | 4999 | 9999 | 0.0012 | 0.0006 |

| Ab | I ELISA-Human ACVR2B (10 pt) | J ELISA Mouse ACVR2A (10 pt) | K ELISA Mouse ACVR2A (8 pt) | L ELISA Mouse ACVR2B (10 pt) | M Phospho-SMAD3 Human Skeletal Muscle GDF8 | N SMAD 2/3/4 Reporter HEK293 | O Clone 4E1 + Human ACVR2A, Activin A, 10 pt |
|---|---|---|---|---|---|---|---|
| 365_B10 | 9999 | 0.001 | 0.0009 | 9999 | 0.031 | 0.3543 | 0.0354 |
| 365_E04 | | | 0.0048 | | | | |
| 365_H08 | 9999 | 0.959 | 0.0055 | 9999 | | 9999 | 9999 |
| 366_D01 | 9999 | 0.001 | | 9999 | 0.1323 | 0.4973 | 0.1006 |
| 366_G06 | | | 0.0041 | | | | |

TABLE 5-continued

| | | | | | | | |
|---|---|---|---|---|---|---|---|
| 367_H01 | 9999 | 0.0054 | 0.0025 | 9999 | 0.0248 | 3.579 | 0.3607 |
| 368_A02 | | | 0.008 | | | | |
| 368_A12 | 9999 | 0.0015 | 0.0024 | 9999 | 0.046 | 0.9454 | 0.1142 |
| 368_B10 | 9999 | 0.0053 | 0.0045 | 9999 | 0.0469 | 1.387 | 0.0632 |
| 368_F10 | 9999 | 0.0022 | | 9999 | 0.2567 | 0.8681 | 0.2092 |
| 369_B03 | 9999 | 0.005 | 0.0024 | 9999 | 0.0157 | 0.5055 | 0.1569 |
| 369_H03 | 9999 | 0.0052 | 0.01 | 9999 | 0.3262 | 9999 | 0.0957 |
| 370_B01 | 9999 | 0.0004 | 0.001 | 9999 | 0.0121 | 0.0535 | 0.0154 |
| 371_D07 | 9999 | 0.0057 | 0.01 | 9999 | 0.1265 | 4.187 | 0.2217 |
| 372_B11 | 9999 | 0.0032 | | 9999 | 0.3973 | 4.276 | 0.2725 |
| 373_E11 | 9999 | 0.0012 | | 9999 | 0.0229 | 0.4333 | 0.1403 |
| 373_H02 | 9999 | 0.003 | 0.0011 | 9999 | 0.0145 | 0.3413 | 0.0251 |
| 374_B02 | 9999 | 0.0378 | 0.0032 | 9999 | 0.1183 | 9999 | 0.1766 |
| 375_A04 | 9999 | 0.0007 | 0.0004 | 9999 | 0.0076 | 0.0551 | 0.0071 |
| 375_A11 | 9999 | 0.003 | 0.0007 | 9999 | 0.0127 | 0.5299 | 0.0359 |
| 375_H01 | | | 0.015 | | | | |
| 376_G02 | 9999 | 0.002 | 0.002 | 9999 | 0.1901 | 0.3337 | 0.0838 |
| 365_G06 | 9999 | 0.0031 | 0.0073 | 9999 | 0.0875 | 0.2124 | 0.0309 |
| 367_F10 | 9999 | 0.0017 | 0.0119 | 9999 | 0.1176 | 0.4584 | 0.359 |
| 368_B12 | 9999 | 0.0051 | 0.006 | 9999 | 0.0918 | 1.746 | 0.1618 |
| 369_A12 | 9999 | 0.0008 | 0.0014 | 9999 | 0.0119 | 0.0948 | 0.0311 |
| 369_E03 | 9999 | 0.0009 | 0.0043 | 5.543 | 0.0235 | 1.043 | 0.1305 |
| 370_B06 | 9999 | 0.0023 | 0.0015 | 9999 | 0.0061 | 0.3843 | 0.0467 |
| 371_B11 | 9999 | 0.001 | 0.0011 | 9999 | 0.015 | 0.2384 | 0.0316 |
| 371_C02 | 9999 | 0.0021 | 0.0045 | 9999 | 0.0488 | 1.01 | 0.0958 |
| 373_D11 | 9999 | 0.0003 | | 9999 | 0.0081 | 0.3066 | 0.0225 |
| 373_G05 | 9999 | 0.0047 | 0.0021 | 9999 | 0.0231 | 1.969 | 0.0383 |
| 376_D08 | 9999 | 0.0005 | | 9999 | 0.0065 | 0.0343 | 0.41 |
| 376_F09 | 9999 | 0.0041 | 0.0028 | 9999 | 0.0855 | 0.4007 | 0.0407 |
| 365_E12 | | | 0.0017 | | | | |
| 365_F02 | 9999 | 0.0006 | 0.0005 | 9999 | 0.026 | 0.8487 | 0.0639 |
| 365_G05 | | | 0.0072 | | | | |
| 367_A03 | | | 0.0132 | | | | |
| 367_C07 | 9999 | 0.0007 | | 9999 | 0.0716 | 9999 | 0.1569 |
| 369_A07 | 9999 | 0.0006 | 0.0006 | 9999 | 0.0149 | 0.1323 | 0.0155 |
| 369_B05 | | | 0.0018 | | | | |
| 370_A02 | | | 0.005 | | | | |
| 370_H02 | 9999 | 0.0008 | 0.0012 | 9999 | 0.0226 | 0.6343 | 0.0355 |
| 371_A10 | | | 0.0056 | | | | |
| 371_C12 | 9999 | 0.0005 | 0.0007 | 9999 | 0.0206 | 0.5658 | 0.0187 |
| 371_D02 | | | 0.0017 | | | | |
| 371_G09 | | | 0.0019 | | | | |
| 371_G11 | 9999 | 0.0034 | 0.0031 | 9999 | 0.1361 | 9999 | 0.3384 |
| 372_B02 | 9999 | 0.0014 | 0.0017 | 9999 | 0.1505 | 1.675 | 0.1778 |
| 372_D03 | 9999 | 0.0009 | 0.0009 | 9999 | 0.058 | 0.1379 | 0.0456 |
| 373_A03 | 9999 | 0.0008 | 0.0007 | 9999 | 0.0148 | 0.559 | 0.009 |
| 373_A05 | | | 0.0022 | | | | |
| 373_A09 | | | 0.0009 | | | | |
| 373_A11 | | | 0.0006 | | | | |
| 373_B05 | | | 0.0021 | | | | |
| 373_C07 | 9999 | 0.0025 | 0.0014 | 9999 | 0.0048 | 1.208 | 0.0686 |
| 373_F08 | 2.32 | 0.0004 | 0.0005 | 2 | 0.005 | 0.3677 | 0.0315 |
| 373_F12 | | | 0.0009 | | | | |
| 373_G08 | 9999 | 0.0007 | 0.0009 | 9999 | 0.0057 | 0.3073 | 0.0711 |
| 373_H03 | 9999 | 0.0024 | | 9999 | 0.0129 | 0.808 | 0.1144 |
| 374_B03 | 9999 | 0.0008 | 0.0006 | 9999 | 0.027 | 0.2394 | 0.0399 |
| 374_C01 | 9999 | 0.0263 | | 9999 | 0.115 | 0.8145 | 4.942 |
| 374_C09 | 9999 | 0.007 | 0.004 | 9999 | 0.1888 | 0.7011 | 0.2959 |
| 374_C12 | 0.4165 | 0.0012 | 0.0005 | 0.397 | 0.027 | 0.1579 | 0.083 |
| 374_D05 | 9999 | 0.0066 | 0.0018 | 9999 | 0.0177 | 1.597 | 0.0851 |
| 374_D10 | 1.021 | 0.0022 | | 1.053 | 0.1264 | 9999 | 4.658 |
| 374_G08 | 9999 | 0.0014 | 0.0009 | 9999 | 0.034 | 0.542 | 0.0781 |
| 375_A01 | | | 0.001 | | | | |
| 375_A07 | 9999 | 0.001 | | 9999 | 0.014 | 0.0154 | 0.0922 |
| 375_A12 | 9999 | 0.0005 | | 9999 | 0.0469 | 1.051 | 0.0415 |
| 375_D10 | | | 0.0019 | | | | |
| 375_E05 | | | 0.0007 | | | | |
| 375_E10 | 9999 | 0.0007 | 0.0005 | 9999 | 0.0091 | 0.2237 | 0.0215 |
| 375_F02 | 9999 | 0.0028 | | 9999 | 0.0076 | 0.6181 | 0.0247 |
| 375_G05 | 2.852 | 0.0004 | 0.0005 | 2 | 0.0052 | 0.0108 | 0.0668 |
| 375_H05 | 9999 | 0.0007 | 0.0005 | 9999 | 0.0346 | 0.2948 | 0.0342 |
| 376_A03 | | | 0.0014 | | | | |
| 376_B10 | | | 0.0017 | | | | |
| 376_C08 | 9999 | 0.0048 | | 9999 | 0.0505 | 1.353 | 0.1794 |
| 376_F01 | 0.0922 | 0.008 | 0.003 | 0.0924 | 0.5947 | 9999 | 0.6449 |
| 376_F06 | 9999 | 0.0032 | 0.0017 | 9999 | 0.0544 | 9999 | 0.1295 |
| 376_G05 | 9999 | 0.0014 | 0.0005 | 9999 | 0.0558 | 0.3712 | 0.0755 |
| 376_G10 | | | 0.0032 | | | | |
| 376_H01 | 0.1094 | 0.0009 | 0.001 | 0.0981 | 0.552 | 0.6002 | 0.0329 |
| 375_H11 | 9999 | 0.0004 | 0.0004 | 9999 | 0.0042 | 0.0775 | 0.0084 |

TABLE 5-continued

| | | | | | | | |
|---|---|---|---|---|---|---|---|
| 367_A02 | 9999 | 0.0053 | | 9999 | 0.1591 | 2.765 | 0.065 |
| 368_G03 | 9999 | 0.0026 | 0.008 | 9999 | 0.299 | 1.678 | 0.4619 |
| 368_H06 | | | 0.0023 | | | | |
| 369_C12 | 9999 | 0.0007 | 0.0006 | 9999 | 0.0094 | 0.0821 | 0.0435 |
| 369_E08 | | | 0.0023 | | | | |
| 369_F09 | 2 | 0.001 | | 2 | 0.0325 | 1.095 | 0.1356 |
| 369_H08 | 9999 | 0.001 | 0.0026 | 9999 | 0.0308 | 0.7511 | 0.074 |
| 369_H12 | 9999 | 0.0005 | 0.001 | 9999 | 0.0303 | 0.3774 | 0.0815 |
| 370_C06 | 9999 | 0.0005 | 0.0008 | 9999 | 0.0111 | 4999 | 0.05 |
| 370_C07 | 9999 | 0.0006 | 0.0005 | 9999 | 0.0044 | 0.1452 | 0.0213 |
| 370_D03 | 9999 | 0.0017 | 0.0016 | 9999 | 0.0165 | 0.4708 | 0.0649 |
| 370_E04 | 9999 | 0.0008 | 0.0005 | 9999 | 0.0136 | 0.5966 | 0.0416 |
| 370_F12 | 9999 | 0.0007 | 0.0005 | 9999 | 0.0056 | 0.1288 | 0.0096 |
| 371_B02 | 9999 | 0.0005 | 0.0018 | 9999 | 0.0076 | 0.0454 | 0.0091 |
| 371_E12 | 9999 | 0.0011 | | 9999 | 0.0374 | 0.3155 | 0.1173 |
| 371_F09 | 9999 | 0.0005 | | 9999 | 0.0311 | 0.31 | 0.0405 |
| 371_G01 | | | 0.0012 | | | | |
| 371_H11 | | | 0.0008 | | | | |
| 372_B09 | 9999 | 0.0006 | 0.0008 | 9999 | 0.0182 | 0.4639 | 0.055 |
| 373_D06 | 9999 | 0.0003 | | 9999 | 0.0303 | 0.4069 | 0.0807 |
| 373_F07 | 9999 | 0.0014 | | 9999 | 0.0059 | 0.397 | 0.0413 |
| 374_A05 | 9999 | 0.0003 | 0.0006 | 9999 | 0.0081 | 0.2057 | 0.0166 |
| 374_C10 | 9999 | 0.0007 | 0.001 | 9999 | 0.0582 | 0.0544 | 0.3012 |
| 374_G05 | 9999 | 0.0017 | 0.0006 | 9999 | 0.0132 | 0.4163 | 0.0192 |
| 365_A12 | 0.7559 | 0.0059 | 0.0071 | 0.3945 | 0.9032 | 5.406 | 1.133 |
| 365_B11 | | | 0.0032 | | | | |
| 365_E05 | 9999 | 0.0042 | | 9999 | 0.2437 | 0.367 | 0.0548 |
| 365_E07 | 9999 | 0.0048 | 0.0101 | 9999 | 0.3183 | 9999 | 0.9486 |
| 365_B12 | 9999 | 0.0009 | 0.001 | 9999 | 0.8392 | 0.3748 | 0.053 |
| 367_F03 | | | 0.007 | | | | |
| 367_H06 | 9999 | 0.0012 | | 9999 | 0.108 | 0.9681 | 0.3781 |
| 367_H11 | 9999 | 0.002 | 0.0008 | 9999 | 0.0703 | 1.207 | 0.118 |
| 368_F03 | 9999 | 0.0189 | 0.1583 | 9999 | 0.8118 | 3.259 | 3.216 |
| 369_D02 | 9999 | 0.0004 | | 9999 | 0.0135 | 0.1748 | 0.0252 |
| 369_F01 | 9999 | 0.0007 | | 9999 | 0.0317 | 0.5256 | 0.1112 |
| 369_F06 | | | 0.0032 | | | | |
| 369_G01 | 9999 | 0.0004 | | 9999 | 0.0116 | 0.1187 | 0.0275 |
| 369_H06 | 9999 | 0.0005 | 0.0002 | 9999 | 0.0058 | 9999 | 0.0225 |
| 370_A02 | | | 0.0039 | | | | |
| 370_A12 | 9999 | 0.0008 | 0.0015 | 9999 | 0.0632 | 0.031 | 0.0036 |
| 370_C01 | | | 0.0015 | | | | |
| 370_C03 | 9999 | 0.0004 | 0.0004 | 9999 | 0.0029 | 0.0133 | 0.0035 |
| 370_C05 | 9999 | 0.0011 | 0.0024 | 9999 | 0.0082 | 0.2655 | 0.0343 |
| 370_C08 | | | 0.0016 | | | | |
| 370_D04 | 9999 | 0.0004 | 0.0006 | 9999 | 0.0074 | 0.0452 | 0.0153 |
| 370_E09 | 9999 | 0.0005 | 0.0006 | 9999 | 0.0093 | 0.1225 | 0.009 |
| 370_H01 | 9999 | 0.0005 | 0.0003 | 9999 | 0.0093 | 4999 | 0.039 |
| 371_A05 | | | 0.0014 | | | | |
| 371_B07 | 1.77 | 0.0011 | 0.0012 | 9999 | 0.0402 | 0.4951 | 0.0734 |
| 371_F01 | | | 0.0046 | | | | |
| 371_F04 | | | 0.0022 | | | | |
| 372_A04 | 9999 | 0.0027 | | 9999 | 0.0193 | 0.0367 | 0.0423 |
| 372_D02 | | | 0.0027 | | | | |
| 372_F03 | 9999 | 0.0004 | 0.0008 | 9999 | 0.0646 | 0.1972 | 0.0233 |
| 372_F08 | 9999 | 0.0008 | | 9999 | 0.023 | 0.3148 | 0.0248 |
| 372_F09 | 9999 | 0.0009 | 0.0008 | 9999 | 0.018 | 1.8 | 0.087 |
| 373_A10 | 9999 | 0.0006 | | 9999 | 0.0111 | 0.0965 | 0.0534 |
| 373_B04 | 9999 | 0.0027 | 0.0013 | 9999 | 0.0093 | 1.028 | 0.1154 |
| 373_C02 | 9999 | 0.0052 | | 9999 | 0.0083 | 1.389 | 0.1045 |
| 373_C06 | | | 0.001 | | | | |
| 373_D04 | 9999 | 0.0005 | | 9999 | 0.0078 | 0.137 | 0.0189 |
| 373_D10 | 9999 | 0.0012 | 0.0005 | 9999 | 0.006 | 0.0821 | 0.0175 |
| 374_B04 | 9999 | 0.0015 | 0.0003 | 9999 | 0.0093 | 0.1014 | 0.0155 |
| 374_B06 | 9999 | 0.0009 | 0.004 | 9999 | 0.0407 | 0.3649 | 0.0717 |
| 374_C03 | 9999 | 0.0004 | | 9999 | 0.0094 | 0.0468 | 0.0144 |
| 374_C06 | 9999 | 0.0015 | 0.0007 | 9999 | 0.0138 | 0.296 | 0.015 |
| 374_D08 | 9999 | 0.2008 | 0.01 | 9999 | 0.2299 | 9999 | 1.285 |
| 374_E01 | | | 0.001 | | | | |
| 374_E05 | 0.1534 | 0.0014 | 0.0011 | 0.1414 | 0.0497 | 0.6495 | 2.729 |
| 365_E02 | 9999 | 0.0047 | 0.0013 | 9999 | 0.3412 | 9999 | 0.4773 |
| 376_C06 | 9999 | 0.0022 | 0.001 | 9999 | 0.0107 | 0.1983 | 0.0817 |
| 368_D10 | 9999 | 0.0014 | | 9999 | 0.0601 | 0.2942 | 0.0389 |
| 374_C08 | 9999 | 0.0285 | | 9999 | 0.6848 | 9999 | 9999 |
| 376_A06 | 9999 | 0.0004 | 0.0003 | 9999 | 0.0043 | 0.0203 | 0.0037 |
| 365_F07 | 9999 | 0.0013 | 0.0007 | 9999 | 0.011 | 0.0925 | 0.0354 |
| 376_B01 | 9999 | 0.0004 | | 9999 | 0.0085 | 0.369 | 0.0283 |
| 365_D05 | 9999 | 0.0008 | | 9999 | 0.0209 | 0.6678 | 0.1817 |
| 369_G07 | 9999 | 0.0006 | | 9999 | 0.012 | 0.0327 | 0.1333 |
| 373_G05 | 9999 | 0.0002 | | 9999 | 0.0059 | 0.1546 | 0.0202 |
| 376_B06 | 9999 | 0.0005 | 0.0004 | 9999 | 0.0042 | 0.0005 | 0.0164 |

TABLE 5-continued

| | | | | | | | |
|---|---|---|---|---|---|---|---|
| 374_C11 | 0.3945 | 0.0015 | | 0.3304 | 0.0266 | 0.6324 | 0.0328 |
| 375_A06 | 9999 | 0.0011 | 0.0004 | 9999 | 0.0318 | 0.1546 | 0.014 |
| 373_E06 | 9999 | 0.0002 | 0.0002 | 9999 | 0.0005 | 0.0089 | 0.0022 |
| 374_C05 | 9999 | 0.0007 | 0.0004 | 9999 | 0.0124 | 0.0142 | 9999 |
| 368_H01 | | | 0.0014 | | | | |
| 373_B03 | | | 0.0005 | | | | |
| 369_A10 | 9999 | 0.001 | 0.0005 | 9999 | 0.0075 | 5000 | 0.071 |
| 366_A05 | 9999 | 0.0005 | 0.0005 | 9999 | 0.0244 | 0.6492 | 0.0524 |
| 375_G07 | 9999 | 0.0016 | 0.001 | 9999 | 0.0112 | 0.2215 | 0.0786 |
| 371_G03 | | | 0.001 | | | | |
| 370_E07 | 9999 | 0.0008 | 0.0003 | 9999 | 0.0046 | 0.0764 | 0.013 |
| 367_G07 | 9999 | 0.0009 | 0.0004 | 9999 | 0.0068 | 0.0843 | 0.0124 |
| 375_C12 | 0.4421 | 0.0004 | 0.0003 | 0.4194 | 0.0063 | 0.0237 | 0.2784 |
| 373_B08 | 9999 | 0.0017 | 0.0004 | 9999 | 0.0102 | 0.1201 | 0.017 |
| 374_A11 | 9999 | 0.0011 | 0.0003 | 9999 | 0.0086 | 0.079 | 0.0188 |
| 373_B11 | 9999 | 0.0003 | | 9999 | 0.0008 | 0.024 | 0.0036 |
| 372_D04 | 9999 | 0.0009 | 0.0005 | 9999 | 0.0114 | 0.0938 | 0.0179 |
| 367_A01 | 9999 | 0.0011 | 0.0007 | 9999 | 0.0065 | 0.1617 | 0.0355 |
| 373_E02 | 9999 | 0.0012 | 0.0005 | 9999 | 0.0049 | 4999 | 4999 |

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (6621 sequences)

SEQ ID NO: 1 - protein, 120 aa, Artificial Sequence
  synthetic polypeptide
EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARAANWHDTALDYWGQGTLVTVSS

SEQ ID NO: 2 - protein, 120 aa, Artificial Sequence
  synthetic polypeptide
EVQLLESGGGLVQPGGSLRLSCAASGFTFDDYSMHWVRQAPGKGLEWVASINYNSGYKGYADSVKGRFTISRDNSKNTLYLQMNSLRAEDTAVYYCARAANWHDTALDYWGQGTLVTVSS

SEQ ID NO: 3 - protein, 120 aa, Artificial Sequence
  synthetic polypeptide
EVQLLESGGGLVQPGGSLRLSCAASGFTFSSYGMHWVRQAPGKGLEWVAGINYNSGYKGYADSVKGRFTISRDNSKNTLYLQMNSLRAEDTAVYYCARAANWHDTHLDYWGQGTLVTVSS

SEQ ID NO: 4 - protein, 120 aa, Artificial Sequence
  synthetic polypeptide
EVQLLESGGGLVQPGGSLRLSCAASGFTFSDYGMHWVRQAPGKGLEWVSGINYNGGYTSYADSVKGRFTISRDNSKNTLYLQMNSLRAEDTAVYYCARAANWHDTALDYWGQGTLVTVSS

SEQ ID NO: 5 - protein, 120 aa, Artificial Sequence
  synthetic polypeptide
EVQLLESGGGLVQPGGSLRLSCAASGFTFSDYGMHWVRQAPGKGLEWVAGINYNGGYKSYADSVKGRFTISRDNSKNTLYLQMNSLRAEDTAVYYCARAANWHDTALDYWGQGTLVTVSS

SEQ ID NO: 6 - protein, 120 aa, Artificial Sequence
  synthetic polypeptide
EVQLLESGGGLVQPGGSLRLSCAASGFTFDSYGMHWVRQAPGKGLEWVASINYNGGYKSYADSVKGRFTISRDNSKNTLYLQMNSLRAEDTAVYYCARAANWHDTALDYWGQGTLVTVSS

SEQ ID NO: 7 - protein, 120 aa, Artificial Sequence
  synthetic polypeptide
EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARAANWHDTHLDYWGQGTLVTVSS

SEQ ID NO: 8 - protein, 120 aa, Artificial Sequence
  synthetic polypeptide
EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAANWHDTALDYWGQGTLVTVSS

SEQ ID NO: 9 - protein, 120 aa, Artificial Sequence
  synthetic polypeptide
EVQLLESGGGLVQPGGSLRLSCAASGFTFSSYGMHWVRQAPGKGLEWVASINYNGGYKSYADSVKGRFTISRDNSKNTLYLQMNSLRAEDTAVYYCARAANWHDTALDYWGQGTLVTVSS

SEQ ID NO: 10 - protein, 120 aa, Artificial Sequence
  synthetic polypeptide
EVQLLESGGGLVQPGGSLRLSCAASGFTFDSYGMNWVRQAPGKGLEWVASINYNSGYKGYADSVKGRFTISRDNSKNTLYLQMNSLRAEDTAVYYCARAANWHDTHLDYWGQGTLVTVSS

SEQ ID NO: 11 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARAANWHDTALDYWGQGTLVTVSS

SEQ ID NO: 12 - protein, 120 aa, Artificial Sequence
  synthetic polypeptide
EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARAANWHDTHLDYWGQGTLVTVSS

SEQ ID NO: 13 - protein, 120 aa, Artificial Sequence
  synthetic polypeptide
EVQLLESGGGLVQPGGSLRLSCAASGFTFDSYGMHWVRQAPGKGLEWVSSINYNGGYTGYADSVKGRFTISRDNSKNTLYLQMNSLRAEDTAVYYCARAANWHDTHLDYWGQGTLVTVSS

SEQ ID NO: 14 - protein, 120 aa, Artificial Sequence
  synthetic polypeptide
EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARAANWHDTHLDYWGQGTLVTVSS

SEQ ID NO: 15 - protein, 120 aa, Artificial Sequence
  synthetic polypeptide
EVQLLESGGGLVQPGGSLRLSCAASGFTFSSYGMHWVRQAPGKGLEWVASINYNGGYTGYADSVKGRFTISRDNSKNTLYLQMNSLRAEDTAVYYCARAANWHDTHLDYWGQGTLVTVSS

SEQ ID NO: 16 - protein, 120 aa, Artificial Sequence
  synthetic polypeptide
EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTALDYWGQGTLVTVSS

SEQ ID NO: 17 - protein, 120 aa, Artificial Sequence
  synthetic polypeptide
EVQLLESGGGLVQPGGSLRLSCAASGFTFSDYSMHWVRQAPGKGLEWVANINYNSGYTSYADSVKGRFTISRDNSKNTLYLQMNSLRAEDTAVYYCARAANWHDTALDYWGQGTLVTVSS

SEQ ID NO: 18 - protein, 120 aa, Artificial Sequence
  synthetic polypeptide
EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAANWHDTHLDYWGQGTLVTVSS

SEQ ID NO: 19 - protein, 120 aa, Artificial Sequence
  synthetic polypeptide
EVQLLESGGGLVQPGGSLRLSCAASGFTFDSYGMHWVRQAPGKGLEWVSNINYNGGYKSYADSVKGRFTISRDNSKNTLYLQMNSLRAEDTAVYYCARAANWHDTALDYWGQGTLVTVSS

SEQ ID NO: 20 - protein, 120 aa, Artificial Sequence
  synthetic polypeptide
EVQLLESGGGLVQPGGSLRLSCAASGFTFSSYGMNWVRQAPGKGLEWVSSINYNSGYTSYADSVKGRFTISRDNSKNTLYLQMNSLRAEDTAVYYCARAANWHDTALDYWGQGTLVTVSS

SEQ ID NO: 21 - protein, 120 aa, Artificial Sequence
  synthetic polypeptide
EVQLLESGGGLVQPGGSLRLSCAASGFTFDSYGMNWVRQAPGKGLEWVSGINYNGGYKSYADSVKGRFTISRDNSKNTLYLQMNSLRAEDTAVYYCARAANWHDTALDYWGQGTLVTVSS

SEQ ID NO: 22 - protein, 120 aa, Artificial Sequence
  synthetic polypeptide
EVQLLESGGGLVQPGGSLRLSCAASGFTFDSYGMNWVRQAPGKGLEWVAGINYNGGYKSYADSVKGRFTISRDNSKNTLYLQMNSLRAEDTAVYYCARAANWHDTHLDYWGQGTLVTVSS

SEQ ID NO: 23 - protein, 120 aa, Artificial Sequence
  synthetic polypeptide
EVQLLESGGGLVQPGGSLRLSCAASGFTFDSYSMHWVRQAPGKGLEWVAGINYNSGYKGYADSVKGRFTISRDNSKNTLYLQMNSLRAEDTAVYYCARAANWHDTHLDYWGQGTLVTVSS

SEQ ID NO: 24 - protein, 120 aa, Artificial Sequence
  synthetic polypeptide
EVQLLESGGGLVQPGGSLRLSCAASGFTFDSYSMHWVRQAPGKGLEWVSSINYNSGYKGYADSVKGRFTISRDNSKNTLYLQMNSLRAEDTAVYYCARAANWHDTALDYWGQGTLVTVSS

SEQ ID NO: 25 - protein, 120 aa, Artificial Sequence
  synthetic polypeptide
EVQLLESGGGLVQPGGSLRLSCAASGFTFDDYGMNWVRQAPGKGLEWVSGINYNGGYTSYADSVKGRFTISRDNSKNTLYLQMNSLRAEDTAVYYCARAANWHDTALDYWGQGTLVTVSS

SEQ ID NO: 26 - protein, 120 aa, Artificial Sequence
  synthetic polypeptide
EVQLLESGGGLVQPGGSLRLSCAASGFTFDSYGMNWVRQAPGKGLEWVSSINYNGGYTSYADSVKGRFTISRDNSKNTLYLQMNSLRAEDTAVYYCARAANWHDTHLDYWGQGTLVTVSS

SEQ ID NO: 27 - protein, 120 aa, Artificial Sequence; identical to SEQ ID NO: 16
  synthetic polypeptide

SEQ ID NO: 28 - protein, 120 aa, Artificial Sequence
  synthetic polypeptide
EVQLLESGGGLVQPGGSLRLSCAASGFTFDSYGMHWVRQAPGKGLEWVSGINYNGGYKSYADSVKGRFTISRDNSKNTLYLQMNSLRAEDTAVYYCARAANWHDTHLDYWGQGTLVTVSS

SEQ ID NO: 29 - protein, 120 aa, Artificial Sequence
  synthetic polypeptide
EVQLLESGGGLVQPGGSLRLSCAASGFTFSSYSMHWVRQAPGKGLEWVSNINYNGGYTGYADSVKGRFTISRDNSKNTLYLQMNSLRAEDTAVYYCARAANWHDTHLDYWGQGTLVTVSS

SEQ ID NO: 30 - protein, 120 aa, Artificial Sequence
  synthetic polypeptide
EVQLLESGGGLVQPGGSLRLSCAASGFTFDSYGMHWVRQAPGKGLEWVAGINYNSGYKSYADSVKGRFTISRDNSKNTLYLQMNSLRAEDTAVYYCARAANWHDTHLDYWGQGTLVTVSS

SEQ ID NO: 31 - protein, 120 aa, Artificial Sequence
  synthetic polypeptide
EVQLLESGGGLVQPGGSLRLSCAASGFTFSSYGMNWVRQAPGKGLEWVASINYNSGYTSYADSVKGRFTISRDNSKNTLYLQMNSLRAEDTAVYYCARAANWHDTHLDYWGQGTLVTVSS

SEQ ID NO: 32 - protein, 120 aa, Artificial Sequence
  synthetic polypeptide
EVQLLESGGGLVQPGGSLRLSCAASGFTFSSYGMNWVRQAPGKGLEWVAGINYNSGYTSYADSVKGRFTISRDNSKNTLYLQMNSLRAEDTAVYYCARAANWHDTHLDYWGQGTLVTVSS

SEQ ID NO: 33 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAANWHDTALDYWGQGTLVTVSS

SEQ ID NO: 34 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAANWHDTALDYWGQGTLVTVSS

SEQ ID NO: 35 - protein, 120 aa, Artificial Sequence
  synthetic polypeptide
EVQLLESGGGLVQPGGSLRLSCAASGFTFSSYSMHWVRQAPGKGLEWVASINYNSGYKSYADSVKGRFTISRDNSKNTLYLQMNSLRAEDTAVYYCARAANWHDTALDYWGQGTLVTVSS

SEQ ID NO: 36 - protein, 120 aa, Artificial Sequence
  synthetic polypeptide
EVQLLESGGGLVQPGGSLRLSCAASGFTFDDYGMHWVRQAPGKGLEWVSGINYNGGYKSYADSVKGRFTISRDNSKNTLYLQMNSLRAEDTAVYYCARAANWHDTALDYWGQGTLVTVSS

SEQ ID NO: 37 - protein, 120 aa, Artificial Sequence
  synthetic polypeptide
EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARAANWHDTHLDYWGQGTLVTVSS

SEQ ID NO: 38 - protein, 120 aa, Artificial Sequence
  synthetic polypeptide
EVQLLESGGGLVQPGGSLRLSCAASGFTFSSYGMHWVRQAPGKGLEWVSGINYNGGYTGYADSVKGRFTISRDNSKNTLYLQMNSLRAEDTAVYYCARAANWHDTALDYWGQGTLVTVSS

SEQ ID NO: 39 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAANWHDTHLDYWGQGTLVTVSS

SEQ ID NO: 40 - protein, 120 aa, Artificial Sequence
  synthetic polypeptide
EVQLLESGGGLVQPGGSLRLSCAASGFTFDSYGMNWVRQAPGKGLEWVSSINYNSGYTGYADSVKGRFTISRDNSKNTLYLQMNSLRAEDTAVYYCARAANWHDTALDYWGQGTLVTVSS

SEQ ID NO: 41 - protein, 120 aa, Artificial Sequence
  synthetic polypeptide
EVQLLESGGGLVQPGGSLRLSCAASGFTFSSYGMNWVRQAPGKGLEWVSGINYNGGYKSYADSVKGRFTISRDNSKNTLYLQMNSLRAEDTAVYYCARAANWHDTALDYWGQGTLVTVSS

SEQ ID NO: 42 - protein, 120 aa, Artificial Sequence
  synthetic polypeptide
EVQLLESGGGLVQPGGSLRLSCAASGFTFDDYGMNWVRQAPGKGLEWVANINYNGGYKGYADSVKGRFTISRDNSKNTLYLQMNSLRAEDTAVYYCARAANWHDTHLDYWGQGTLVTVSS

SEQ ID NO: 43 - protein, 120 aa, Artificial Sequence; identical to SEQ ID NO: 21
  synthetic polypeptide

SEQ ID NO: 44 - protein, 120 aa, Artificial Sequence
  synthetic polypeptide
EVQLLESGGGLVQPGGSLRLSCAASGFTFDDYSMNWVRQAPGKGLEWVSGINYNGGYKSYADSVKGRFTISRDNSKNTLYLQMNSLRAEDTAVYYCARAANWHDTHLDYWGQGTLVTVSS

SEQ ID NO: 45 - protein, 120 aa, Artificial Sequence
  synthetic polypeptide
EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARAANWHDTALDYWGQGTLVTVSS

SEQ ID NO: 46 - protein, 120 aa, Artificial Sequence
  synthetic polypeptide
EVQLLESGGGLVQPGGSLRLSCAASGFTFSSYSMHWVRQAPGKGLEWVAGINYNSGYTSYADSVKGRFTISRDNSKNTLYLQMNSLRAEDTAVYYCARAANWHDTHLDYWGQGTLVTVSS

SEQ ID NO: 47 - protein, 120 aa, Artificial Sequence
  synthetic polypeptide
EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARAANWHDTALDYWGQGTLVTVSS

SEQ ID NO: 48 - protein, 120 aa, Artificial Sequence; identical to SEQ ID NO: 16
  synthetic polypeptide

SEQ ID NO: 49 - protein, 120 aa, Artificial Sequence
  synthetic polypeptide
EVQLLESGGGLVQPGGSLRLSCAASGFTFSSYGMHWVRQAPGKGLEWVAGINYNSGYTSYADSVKGRFTISRDNSKNTLYLQMNSLRAEDTAVYYCARAANWHDTALDYWGQGTLVTVSS

SEQ ID NO: 50 - protein, 120 aa, Artificial Sequence
  synthetic polypeptide
EVQLLESGGGLVQPGGSLRLSCAASGFTFDSYSMHWVRQAPGKGLEWVAGINYNSGYTSYADSVKGRFTISRDNSKNTLYLQMNSLRAEDTAVYYCARAANWHDTHLDYWGQGTLVTVSS

SEQ ID NO: 51 - protein, 120 aa, Artificial Sequence; identical to SEQ ID NO: 37
  synthetic polypeptide

SEQ ID NO: 52 - protein, 120 aa, Artificial Sequence
  synthetic polypeptide
EVQLLESGGGLVQPGGSLRLSCAASGFTFDSYGMNWVRQAPGKGLEWVAGINYNGGYKSYADSVKGRFTISRDNSKNTLYLQMNSLRAEDTAVYYCARAANWHDTALDYWGQGTLVTVSS

SEQ ID NO: 53 - protein, 120 aa, Artificial Sequence
  synthetic polypeptide
EVQLLESGGGLVQPGGSLRLSCAASGFTFSDYGMHWVRQAPGKGLEWVSSINYNSGYKSYADSVKGRFTISRDNSKNTLYLQMNSLRAEDTAVYYCARAANWHDTALDYWGQGTLVTVSS

SEQ ID NO: 54 - protein, 120 aa, Artificial Sequence; identical to SEQ ID NO: 34
  synthetic polypeptide

SEQ ID NO: 55 - protein, 120 aa, Artificial Sequence; identical to SEQ ID NO: 16
  synthetic polypeptide

SEQ ID NO: 56 - protein, 120 aa, Artificial Sequence
  synthetic polypeptide
EVQLLESGGGLVQPGGSLRLSCAASGFTFSDYSMNWVRQAPGKGLEWVAGINYNSGYTSYADSVKGRFTISRDNSKNTLYLQMNSLRAEDTAVYYCARAANWHDTHLDYWGQGTLVTVSS

SEQ ID NO: 57 - protein, 120 aa, Artificial Sequence
  synthetic polypeptide
EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARAANWHDTALDYWGQGTLVTVSS

SEQ ID NO: 58 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSDESPLTFGGGTKVEIK

SEQ ID NO: 59 - protein, 107 aa, Artificial Sequence
  synthetic polypeptide
DIQMTQSPSSLSASVGDRVTITCRASQSILRYLNWYQQKPGKAPKLLIYAATSRASGVPSRFSGSGSGTDFTLTISSLQPEDFATYYCQQSDNLPLTFGGGTKVEIK

SEQ ID NO: 60 - protein, 107 aa, Artificial Sequence
  synthetic polypeptide
DIQMTQSPSSLSASVGDRVTITCRASQSILTYVNWYQQKPGKAPKLVIYATTSLASGVPSRFSGSGSGTDFTLTISSLQPEDFATYYCQQSYNTPLTFGGGTKVEIK

SEQ ID NO: 61 - protein, 107 aa, Artificial Sequence
  synthetic polypeptide
DIQMTQSPSSLSASVGDRVTITCRASQSISTYVNWYQQKPGKAPKLLIYAVTSLASGVPSRFSGSGSGTDFTLTISSLQPEDFATYYCQQSYDNPLTFGGGTKVEIK

SEQ ID NO: 62 - protein, 107 aa, Artificial Sequence
  synthetic polypeptide
DIQMTQSPSSLSASVGDRVTITCRASQSISSYLNWYQQKPGKAPKLVIYAVTSRASGVPSRFSGSGSGTDFTLTISSLQPEDFATYYCQQSYDLPLTFGGGTKVEIK

SEQ ID NO: 63 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYELPLTFGGGTKVEIK

SEQ ID NO: 64 - protein, 107 aa, Artificial Sequence
  synthetic polypeptide
DIQMTQSPSSLSASVGDRVTITCRASQSIISYVNWYQQKPGKAPKLLIYAATSRASGVPSRFSGSGSGTDFTLTISSLQPEDFATYYCQQSYNTPLTFGGGTKVEIK

SEQ ID NO: 65 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYDNPLTFGGGTKVEIK

SEQ ID NO: 66 - protein, 107 aa, Artificial Sequence [sequence omitted]

SEQ ID NO: 67 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYDLPLTFGGGTKVEIK

SEQ ID NO: 68 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSDDSPLTFGGGTKVEIK

SEQ ID NO: 69 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYENPLTFGGGTKVEIK

SEQ ID NO: 70 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYDLPLTFGGGTKVEIK

SEQ ID NO: 71 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYDTPLTFGGGTKVEIK

SEQ ID NO: 72 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYDNPLTFGGGTKVEIK

SEQ ID NO: 73 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYENPLTFGGGTKVEIK

SEQ ID NO: 74 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYSTPLTFGGGTKVEIK

SEQ ID NO: 75 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYNTPLTFGGGTKVEIK

SEQ ID NO: 76 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSYDSPLTFGGGTKVEIK

SEQ ID NO: 77 - protein, 107 aa, Artificial Sequence
  synthetic polypeptide
DIQMTQSPSSLSASVGDRVTITCRASQSISSYVNWYQQKPGKAPKLLIYAVTSRASGVPSRFSGSGSGTDFTLTISSLQPEDFATYYCQQSYDSPLTFGGGTKVEIK

SEQ ID NO: 78 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYDNPLTFGGGTKVEIK

SEQ ID NO: 79 - protein, 107 aa, Artificial Sequence
  synthetic polypeptide
DIQMTQSPSSLSASVGDRVTITCRASQSIISYVNWYQQKPGKAPKLVIYAATSRASGVPSRFSGSGSGTDFTLTISSLQPEDFATYYCQQSYDTPLTFGGGTKVEIK

SEQ ID NO: 80 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYNSPLTFGGGTKVEIK

SEQ ID NO: 81 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYDSPLTFGGGTKVEIK

SEQ ID NO: 82 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQHSYENPLTFGGGTKVEIK

SEQ ID NO: 83 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYENPLTFGGGTKVEIK

SEQ ID NO: 84 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSDELPLTFGGGTKVEIK

SEQ ID NO: 85 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSYDSPLTFGGGTKVEIK

SEQ ID NO: 86 - protein, 107 aa, Artificial Sequence
  synthetic polypeptide
DIQMTQSPSSLSASVGDRVTITCRASQSILTYVNWYQQKPGKAPKLLIYAATSLASGVPSRFSGSGSGTDFTLTISSLQPEDFATYYCQQSYDLPLTFGGGTKVEIK

SEQ ID NO: 87 - protein, 107 aa, Artificial Sequence
  synthetic polypeptide
DIQMTQSPSSLSASVGDRVTITCRASQSIVSYVNWYQQKPGKAPKLLIYAATSLASGVPSRFSGSGSGTDFTLTISSLQPEDFATYYCQQSYDNPLTFGGGTKVEIK

SEQ ID NO: 88 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSYSLPLTFGGGTKVEIK

SEQ ID NO: 89 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYDTPLTFGGGTKVEIK

SEQ ID NO: 90 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYELPLTFGGGTKVEIK

SEQ ID NO: 91 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYDSPLTFGGGTKVEIK

SEQ ID NO: 92 - protein, 107 aa, Artificial Sequence
  synthetic polypeptide
DIQMTQSPSSLSASVGDRVTITCRASQSIVSYLNWYQQKPGKAPKLLIYATTSRASGVPSRFSGSGSGTDFTLTISSLQPEDFATYYCQQSYDTPLTFGGGTKVEIK

SEQ ID NO: 93 - protein, 107 aa, Artificial Sequence
  synthetic polypeptide
DIQMTQSPSSLSASVGDRVTITCRASQSILSYVNWYQQKPGKAPKLLIYVASSRASGVPSRFSGSGSGTDFTLTISSLQPEDFATYYCQQSYSLPLTFGGGTKVEIK

SEQ ID NO: 94 - protein, 107 aa, Artificial Sequence
  synthetic polypeptide
DIQMTQSPSSLSASVGDRVTITCRASQSIISYLNWYQQKPGKAPKLVIYAATSLASGVPSRFSGSGSGTDFTLTISSLQPEDFATYYCQQSYSSPLTFGGGTKVEIK

SEQ ID NO: 95 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYSTPLTFGGGTKVEIK

SEQ ID NO: 96 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYSLPLTFGGGTKVEIK

SEQ ID NO: 97 - protein, 107 aa, Artificial Sequence
  synthetic polypeptide
DIQMTQSPSSLSASVGDRVTITCRASQSILTYLNWYQQKPGKAPKLLIYAVTSRASGVPSRFSGSGSGTDFTLTISSLQPEDFATYYCQQSYDTPLTFGGGTKVEIK

SEQ ID NO: 98 - protein, 107 aa, Artificial Sequence
  synthetic polypeptide
DIQMTQSPSSLSASVGDRVTITCRASQSIVTYVNWYQQKPGKAPKLVIYAATSRASGVPSRFSGSGSGTDFTLTISSLQPEDFATYYCQQSYDSPLTFGGGTKVEIK

SEQ ID NO: 99 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYELPLTFGGGTKVEIK

SEQ ID NO: 100 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYELPLTFGGGTKVEIK

SEQ ID NO: 101 - protein, 107 aa, Artificial Sequence
  synthetic polypeptide
DIQMTQSPSSLSASVGDRVTITCRASQSIISYLNWYQQKPGKAPKLVIYAATSLASGVPSRFSGSGSGTDFTLTISSLQPEDFATYYCQQSYENPLTFGGGTKVEIK

SEQ ID NO: 102 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYNSPLTFGGGTKVEIK

SEQ ID NO: 103 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYDTPLTFGGGTKVEIK

SEQ ID NO: 104 - protein, 107 aa, Artificial Sequence
  synthetic polypeptide
DIQMTQSPSSLSASVGDRVTITCRASQSIISYVNWYQQKPGKAPKLVIYAATSRASGVPSRFSGSGSGTDFTLTISSLQPEDFATYYCQQSYDLPLTFGGGTKVEIK

SEQ ID NO: 105 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYDSPLTFGGGTKVEIK

SEQ ID NO: 106 - protein, 107 aa, Artificial Sequence
  synthetic polypeptide
  misc_feature (93)..(93): Xaa can be any naturally occurring amino acid
DIQMTQSPSSLSASVGDRVTITCRASQSIVSYVNWYQQKPGKAPKLLIYAATSRHSGVPSRFSGSGSGTDFTLTISSLQPEDFATYYCQQSYXNPLTFGGGTKVEIK

SEQ ID NO: 107 - protein, 107 aa, Artificial Sequence; identical to SEQ ID NO: 76
  synthetic polypeptide

SEQ ID NO: 108 - protein, 107 aa, Artificial Sequence; identical to SEQ ID NO: 79
  synthetic polypeptide

SEQ ID NO: 109 - protein, 107 aa, Artificial Sequence
  synthetic polypeptide
DIQMTQSPSSLSASVGDRVTITCRASQSILTYLNWYQQKPGKAPKLVIYYVNNLPSGVPSRFSGSGSGTDFTLTISSLQPEDFATYYCQQSYNSPLTFGGGTKVEIK

SEQ ID NO: 110 - protein, 107 aa, Artificial Sequence
  synthetic polypeptide
DIQMTQSPSSLSASVGDRVTITCRASQSIVSYLNWYQQKPGKAPKLLIYYVTNLASGVPSRFSGSGSGTDFTLTISSLQPEDFATYYCQQSYDNPLTFGGGTKVEIK

SEQ ID NO: 111 - protein, 107 aa, Artificial Sequence
  synthetic polypeptide
DIQMTQSPSSLSASVGDRVTITCRASQSISTYLNWYQQKPGKAPKLVIYAASSLQSGVPSRFSGSGSGTDFTLTISSLQPEDFATYYCQQSYSTPLTFGGGTKVEIK

SEQ ID NO: 112 - protein, 107 aa, Artificial Sequence; identical to SEQ ID NO: 84
  synthetic polypeptide

SEQ ID NO: 113 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYSNPLTFGGGTKVEIK

SEQ ID NO: 114 - protein, 107 aa, Artificial Sequence
  synthetic polypeptide
DIQMTQSPSSLSASVGDRVTITCRASQSISRYLNWYQQKPGKAPKLVIYAATSLASGVPSRFSGSGSGTDFTLTISSLQPEDFATYYCQQSYDNPLTFGGGTKVEIK

SEQ ID NO: 115 - protein, 6 aa, Artificial Sequence
  synthetic polypeptide
SSYGMH

SEQ ID NO: 116 - protein, 6 aa, Artificial Sequence
  synthetic polypeptide
DDYSMH

SEQ ID NO: 117 - protein, 6 aa, Artificial Sequence
  synthetic polypeptide
SSYGMH

SEQ ID NO: 118 - protein, 6 aa, Artificial Sequence
  synthetic polypeptide
SDYGMH

SEQ ID NO: 119 - protein, 6 aa, Artificial Sequence
  synthetic polypeptide
SDYGMH

SEQ ID NO: 120 - protein, 6 aa, Artificial Sequence
  synthetic polypeptide
DSYGMH

SEQ ID NO: 121 - protein, 6 aa, Artificial Sequence
  synthetic polypeptide
DSYSMN

SEQ ID NO: 122 - protein, 6 aa, Artificial Sequence
  synthetic polypeptide
DSYGMH

SEQ ID NO: 123 - protein, 6 aa, Artificial Sequence
  synthetic polypeptide
SSYGMH

SEQ ID NO: 124 - protein, 6 aa, Artificial Sequence
  synthetic polypeptide
DSYGMN

SEQ ID NO: 125 - protein, 6 aa, Artificial Sequence
  synthetic polypeptide
SSYGMN

SEQ ID NO: 126 - protein, 6 aa, Artificial Sequence
  synthetic polypeptide
SSYGMH

SEQ ID NO: 127 - protein, 6 aa, Artificial Sequence
  synthetic polypeptide
DSYGMH

SEQ ID NO: 128 - protein, 6 aa, Artificial Sequence
  synthetic polypeptide
DSYSMN

SEQ ID NO: 129 - protein, 6 aa, Artificial Sequence
  synthetic polypeptide
SSYGMH

SEQ ID NO: 130 - protein, 6 aa, Artificial Sequence
  synthetic polypeptide
DSYGMH

SEQ ID NO: 131 - protein, 6 aa, Artificial Sequence
  synthetic polypeptide
SDYSMH

SEQ ID NO: 132 - protein, 6 aa, Artificial Sequence
  synthetic polypeptide
DSYGMH

SEQ ID NO: 133 - protein, 6 aa, Artificial Sequence
  synthetic polypeptide
DSYGMH

SEQ ID NO: 134 - protein, 6 aa, Artificial Sequence
  synthetic polypeptide
SSYGMN

SEQ ID NO: 135 - protein, 6 aa, Artificial Sequence
  synthetic polypeptide
DSYGMN

SEQ ID NO: 136 - protein, 6 aa, Artificial Sequence
  synthetic polypeptide
DSYGMN

SEQ ID NO: 137 - protein, 6 aa, Artificial Sequence
  synthetic polypeptide
DSYSMH

SEQ ID NO: 138 - protein, 6 aa, Artificial Sequence
  synthetic polypeptide
DSYSMH

SEQ ID NO: 139 - protein, 6 aa, Artificial Sequence
  synthetic polypeptide
DDYGMN

SEQ ID NO: 140 - protein, 6 aa, Artificial Sequence
  synthetic polypeptide
DSYGMN

SEQ ID NO: 141 - protein, 6 aa, Artificial Sequence
  synthetic polypeptide
DSYGMH

SEQ ID NO: 142 - protein, 6 aa, Artificial Sequence
  synthetic polypeptide
DSYGMH

SEQ ID NO: 143 - protein, 6 aa, Artificial Sequence
  synthetic polypeptide
SSYSMH

SEQ ID NO: 144 - protein, 6 aa, Artificial Sequence
  synthetic polypeptide
DSYGMH

SEQ ID NO: 145 - protein, 6 aa, Artificial Sequence
  synthetic polypeptide
SSYGMN

SEQ ID NO: 146 - protein, 6 aa, Artificial Sequence
  synthetic polypeptide
SSYGMN

SEQ ID NO: 147 - protein, 6 aa, Artificial Sequence
  synthetic polypeptide
SSYGMH

SEQ ID NO: 148 - protein, 6 aa, Artificial Sequence
  synthetic polypeptide
SSYGMH

SEQ ID NO: 149 - protein, 6 aa, Artificial Sequence
  synthetic polypeptide
SSYSMH

SEQ ID NO: 150 - protein, 6 aa, Artificial Sequence
  synthetic polypeptide
DDYGMH

SEQ ID NO: 151 - protein, 6 aa, Artificial Sequence
  synthetic polypeptide
SSYGMN

SEQ ID NO: 152 - protein, 6 aa, Artificial Sequence
  synthetic polypeptide
SSYGMH

SEQ ID NO: 153 - protein, 6 aa, Artificial Sequence
  synthetic polypeptide
SSYGMH

SEQ ID NO: 154 - protein, 6 aa, Artificial Sequence
  synthetic polypeptide
DSYGMN

SEQ ID NO: 155 - protein, 6 aa, Artificial Sequence
  synthetic polypeptide
SSYGMN

SEQ ID NO: 156 - protein, 6 aa, Artificial Sequence
  synthetic polypeptide
DDYGMN

SEQ ID NO: 157 - protein, 6 aa, Artificial Sequence
  synthetic polypeptide
DSYGMN

SEQ ID NO: 158 - protein, 6 aa, Artificial Sequence
  synthetic polypeptide
DDYSMN

SEQ ID NO: 159 - protein, 6 aa, Artificial Sequence
  synthetic polypeptide
DSYGMN

SEQ ID NO: 160 - protein, 6 aa, Artificial Sequence
  synthetic polypeptide
SSYSMH

SEQ ID NO: 161 - protein, 6 aa, Artificial Sequence
  synthetic polypeptide
SSYGMN

SEQ ID NO: 162 - protein, 6 aa, Artificial Sequence
  synthetic polypeptide
DSYGMH

SEQ ID NO: 163 - protein, 6 aa, Artificial Sequence
  synthetic polypeptide
SSYGMH

SEQ ID NO: 164 - protein, 6 aa, Artificial Sequence
  synthetic polypeptide
DSYSMH

SEQ ID NO: 165 - protein, 6 aa, Artificial Sequence
  synthetic polypeptide
SSYGMN

SEQ ID NO: 166 - protein, 6 aa, Artificial Sequence
  synthetic polypeptide
DSYGMN

SEQ ID NO: 167 - protein, 6 aa, Artificial Sequence
  synthetic polypeptide
SDYGMH

SEQ ID NO: 168 - protein, 6 aa, Artificial Sequence
  synthetic polypeptide
SSYGMH

SEQ ID NO: 169 - protein, 6 aa, Artificial Sequence
  synthetic polypeptide
DSYGMH

SEQ ID NO: 170 - protein, 6 aa, Artificial Sequence
  synthetic polypeptide
SDYSMN

SEQ ID NO: 171 - protein, 6 aa, Artificial Sequence
  synthetic polypeptide
SDYGMN

SEQ ID NO: 172 - protein, 13 aa, Artificial Sequence
  synthetic polypeptide
WVASINYNSGYTS

SEQ ID NO: 173 - protein, 13 aa, Artificial Sequence
  synthetic polypeptide
WVASINYNSGYKG

SEQ ID NO: 174 - protein, 13 aa, Artificial Sequence
  synthetic polypeptide
WVAGINYNSGYKG

SEQ ID NO: 175 - protein, 13 aa, Artificial Sequence
  synthetic polypeptide
WVSGINYNGGYTS

SEQ ID NO: 176 - protein, 13 aa, Artificial Sequence
  synthetic polypeptide
WVAGINYNGGYKS

SEQ ID NO: 177 - protein, 13 aa, Artificial Sequence
  synthetic polypeptide
WVASINYNGGYKS

SEQ ID NO: 178 - protein, 13 aa, Artificial Sequence
  synthetic polypeptide
WVSGINYNSGYKG

SEQ ID NO: 179 - protein, 13 aa, Artificial Sequence
  synthetic polypeptide
WVSSINYNGGYTS

SEQ ID NO: 180 - protein, 13 aa, Artificial Sequence
  synthetic polypeptide
WVASINYNGGYKS

SEQ ID NO: 181 - protein, 13 aa, Artificial Sequence
  synthetic polypeptide
WVASINYNSGYKG

SEQ ID NO: 182 - protein, 13 aa, Artificial Sequence
  synthetic polypeptide
WVAGINYNGGYTS

SEQ ID NO: 183 - protein, 13 aa, Artificial Sequence
  synthetic polypeptide
WVSSINYNGGYTG

SEQ ID NO: 184 - protein, 13 aa, Artificial Sequence
  synthetic polypeptide
WVSSINYNGGYTG

SEQ ID NO: 185 - protein, 13 aa, Artificial Sequence
  synthetic polypeptide
WVAGINYNGGYTG

SEQ ID NO: 186 - protein, 13 aa, Artificial Sequence
  synthetic polypeptide
WVASINYNGGYTG

SEQ ID NO: 187 - protein, 13 aa, Artificial Sequence
  synthetic polypeptide
WVASINYNGGYTS

SEQ ID NO: 188 - protein, 13 aa, Artificial Sequence
  synthetic polypeptide
WVANINYNSGYTS

SEQ ID NO: 189 - protein, 13 aa, Artificial Sequence
  synthetic polypeptide
WVASINYNGGYTS

SEQ ID NO: 190 - protein, 13 aa, Artificial Sequence
  synthetic polypeptide
WVSNINYNGGYKS

SEQ ID NO: 191 - protein, 13 aa, Artificial Sequence
  synthetic polypeptide
WVSSINYNSGYTS

SEQ ID NO: 192 - protein, 13 aa, Artificial Sequence
  synthetic polypeptide
WVSGINYNGGYKS

SEQ ID NO: 193 - protein, 13 aa, Artificial Sequence
  synthetic polypeptide
WVAGINYNGGYKS

SEQ ID NO: 194 - protein, 13 aa, Artificial Sequence
  synthetic polypeptide
WVAGINYNSGYKG

SEQ ID NO: 195 - protein, 13 aa, Artificial Sequence
  synthetic polypeptide
WVSSINYNSGYKG

SEQ ID NO: 196 - protein, 13 aa, Artificial Sequence
  synthetic polypeptide
WVSGINYNGGYTS

SEQ ID NO: 197 - protein, 13 aa, Artificial Sequence
  synthetic polypeptide
WVSSINYNGGYTS

SEQ ID NO: 198 - protein, 13 aa, Artificial Sequence
  synthetic polypeptide
WVASINYNGGYTS

SEQ ID NO: 199 - protein, 13 aa, Artificial Sequence
  synthetic polypeptide
WVSGINYNGGYKS

SEQ ID NO: 200 - protein, 13 aa, Artificial Sequence
  synthetic polypeptide
WVSNINYNGGYTG

SEQ ID NO: 201 - protein, 13 aa, Artificial Sequence
  synthetic polypeptide
WVAGINYNSGYKS

SEQ ID NO: 202 - protein, 13 aa, Artificial Sequence
  synthetic polypeptide
WVASINYNSGYTS

SEQ ID NO: 203 - protein, 13 aa, Artificial Sequence
  synthetic polypeptide
WVAGINYNSGYTS

SEQ ID NO: 204 - protein, 13 aa, Artificial Sequence
  synthetic polypeptide
WVAGINYNGGYTS

SEQ ID NO: 205 - protein, 13 aa, Artificial Sequence
  synthetic polypeptide
WVASINYNGGYTS

SEQ ID NO: 206 - protein, 13 aa, Artificial Sequence
  synthetic polypeptide
WVASINYNSGYKS

SEQ ID NO: 207 - protein, 13 aa, Artificial Sequence
  synthetic polypeptide
WVSGINYNGGYKS

SEQ ID NO: 208 - protein, 13 aa, Artificial Sequence
  synthetic polypeptide
WVASINYNGGYTS

SEQ ID NO: 209 - protein, 13 aa, Artificial Sequence
  synthetic polypeptide
WVSGINYNGGYTG

SEQ ID NO: 210 - protein, 13 aa, Artificial Sequence
  synthetic polypeptide
WVASINYNGGYTS

SEQ ID NO: 211 - protein, 13 aa, Artificial Sequence
  synthetic polypeptide
WVSSINYNSGYTG

SEQ ID NO: 212 - protein, 13 aa, Artificial Sequence
  synthetic polypeptide
WVSGINYNGGYKS

SEQ ID NO: 213 - protein, 13 aa, Artificial Sequence
  synthetic polypeptide
WVANINYNGGYKG

SEQ ID NO: 214 - protein, 13 aa, Artificial Sequence
  synthetic polypeptide
WVSGINYNGGYKS

SEQ ID NO: 215 - protein, 13 aa, Artificial Sequence
  synthetic polypeptide
WVSGINYNGGYKS

SEQ ID NO: 216 - protein, 13 aa, Artificial Sequence
  synthetic polypeptide
WVSGINYNGGYTS

SEQ ID NO: 217 - protein, 13 aa, Artificial Sequence
  synthetic polypeptide
WVAGINYNSGYTS

SEQ ID NO: 218 - protein, 13 aa, Artificial Sequence
  synthetic polypeptide
WVASINYNGGYTS

SEQ ID NO: 219 - protein, 13 aa, Artificial Sequence
  synthetic polypeptide
WVASINYNGGYTS

SEQ ID NO: 220 - protein, 13 aa, Artificial Sequence
  synthetic polypeptide
WVAGINYNSGYTS

SEQ ID NO: 221 - protein, 13 aa, Artificial Sequence
  synthetic polypeptide
WVAGINYNSGYTS

SEQ ID NO: 222 - protein, 13 aa, Artificial Sequence
  synthetic polypeptide
WVASINYNGGYTS

SEQ ID NO: 223 - protein, 13 aa, Artificial Sequence
  synthetic polypeptide
WVAGINYNGGYKS

SEQ ID NO: 224 - protein, 13 aa, Artificial Sequence
  synthetic polypeptide
WVSSINYNSGYKS

SEQ ID NO: 225 - protein, 13 aa, Artificial Sequence
  synthetic polypeptide
WVASINYNGGYTS

SEQ ID NO: 226 - protein, 13 aa, Artificial Sequence
  synthetic polypeptide
WVASINYNGGYTS

SEQ ID NO: 227 - protein, 13 aa, Artificial Sequence
  synthetic polypeptide
WVAGINYNSGYTS

SEQ ID NO: 228 - protein, 13 aa, Artificial Sequence
  synthetic polypeptide
WVSGINYNGGYTS

SEQ ID NO: 229 - protein, 12 aa, Artificial Sequence
  synthetic polypeptide
ARAANWHDTALD

SEQ ID NO: 230 - protein, 12 aa, Artificial Sequence
  synthetic polypeptide
ARAANWHDTALD

SEQ ID NO: 231 - protein, 12 aa, Artificial Sequence
  synthetic polypeptide
ARAANWHDTHLD

SEQ ID NO: 232 - protein, 12 aa, Artificial Sequence
  synthetic polypeptide
ARAANWHDTALD

SEQ ID NO: 233 - protein, 12 aa, Artificial Sequence
  synthetic polypeptide
ARAANWHDTALD

SEQ ID NO: 234 - protein, 12 aa, Artificial Sequence
  synthetic polypeptide
ARAANWHDTALD

SEQ ID NO: 235 - protein, 12 aa, Artificial Sequence
  synthetic polypeptide
ARAANWHDTHLD

SEQ ID NO: 236 - protein, 12 aa, Artificial Sequence
  synthetic polypeptide
ARAANWHDTALD

SEQ ID NO: 237 - protein, 12 aa, Artificial Sequence
  synthetic polypeptide
ARAANWHDTALD

SEQ ID NO: 238 - protein, 12 aa, Artificial Sequence
  synthetic polypeptide
ARAANWHDTHLD

SEQ ID NO: 239 - protein, 12 aa, Artificial Sequence
  synthetic polypeptide
ARAANWHDTALD

SEQ ID NO: 240 - protein, 12 aa, Artificial Sequence
  synthetic polypeptide
ARAANWHDTHLD

SEQ ID NO: 241 - protein, 12 aa, Artificial Sequence
  synthetic polypeptide
ARAANWHDTHLD

SEQ ID NO: 242 - protein, 12 aa, Artificial Sequence
  synthetic polypeptide
ARAANWHDTHLD

SEQ ID NO: 243 - protein, 12 aa, Artificial Sequence
  synthetic polypeptide
ARAANWHDTHLD

SEQ ID NO: 244 - protein, 12 aa, Artificial Sequence
  synthetic polypeptide
ARAANWHDTALD

SEQ ID NO: 245 - protein, 12 aa, Artificial Sequence
  synthetic polypeptide
ARAANWHDTALD

SEQ ID NO: 246 - protein, 12 aa, Artificial Sequence
  synthetic polypeptide
ARAANWHDTHLD

SEQ ID NO: 247 - protein, 12 aa, Artificial Sequence
  synthetic polypeptide
ARAANWHDTALD

SEQ ID NO: 248 - protein, 12 aa, Artificial Sequence
  synthetic polypeptide
ARAANWHDTALD

SEQ ID NO: 249 - protein, 12 aa, Artificial Sequence
  synthetic polypeptide
ARAANWHDTALD

SEQ ID NO: 250 - protein, 12 aa, Artificial Sequence
  synthetic polypeptide
ARAANWHDTHLD

SEQ ID NO: 251 - protein, 12 aa, Artificial Sequence
  synthetic polypeptide
ARAANWHDTHLD

SEQ ID NO: 252 - protein, 12 aa, Artificial Sequence
  synthetic polypeptide
ARAANWHDTALD

SEQ ID NO: 253 - protein, 12 aa, Artificial Sequence
  synthetic polypeptide
ARAANWHDTALD

SEQ ID NO: 254 - protein, 12 aa, Artificial Sequence
  synthetic polypeptide
ARAANWHDTHLD

SEQ ID NO: 255 - protein, 12 aa, Artificial Sequence
  synthetic polypeptide
ARAANWHDTALD

SEQ ID NO: 256 - protein, 12 aa, Artificial Sequence
  synthetic polypeptide
ARAANWHDTHLD

SEQ ID NO: 257 - protein, 12 aa, Artificial Sequence
  synthetic polypeptide
ARAANWHDTHLD

SEQ ID NO: 258 - protein, 12 aa, Artificial Sequence
  synthetic polypeptide
ARAANWHDTHLD

SEQ ID NO: 259 - protein, 12 aa, Artificial Sequence
  synthetic polypeptide
ARAANWHDTHLD

SEQ ID NO: 260 - protein, 12 aa, Artificial Sequence
  synthetic polypeptide
ARAANWHDTHLD

SEQ ID NO: 261 - protein, 12 aa, Artificial Sequence
  synthetic polypeptide
ARAANWHDTALD

SEQ ID NO: 262 - protein, 12 aa, Artificial Sequence
  synthetic polypeptide
ARAANWHDTALD

SEQ ID NO: 263 - protein, 12 aa, Artificial Sequence
  synthetic polypeptide
ARAANWHDTALD

SEQ ID NO: 264 - protein, 12 aa, Artificial Sequence
  synthetic polypeptide
ARAANWHDTALD

SEQ ID NO: 265 - protein, 12 aa, Artificial Sequence
  synthetic polypeptide
ARAANWHDTHLD

SEQ ID NO: 266 - protein, 12 aa, Artificial Sequence
  synthetic polypeptide
ARAANWHDTALD

SEQ ID NO: 267 - protein, 12 aa, Artificial Sequence
  synthetic polypeptide
ARAANWHDTHLD

SEQ ID NO: 268 - protein, 12 aa, Artificial Sequence
  synthetic polypeptide
ARAANWHDTALD

SEQ ID NO: 269 - protein, 12 aa, Artificial Sequence
  synthetic polypeptide
ARAANWHDTALD

SEQ ID NO: 270 - protein, 12 aa, Artificial Sequence
  synthetic polypeptide
ARAANWHDTHLD

SEQ ID NO: 271 - protein, 12 aa, Artificial Sequence
  synthetic polypeptide
ARAANWHDTALD

SEQ ID NO: 272 - protein, 12 aa, Artificial Sequence
  synthetic polypeptide
ARAANWHDTHLD

SEQ ID NO: 273 - protein, 12 aa, Artificial Sequence
  synthetic polypeptide
ARAANWHDTALD

SEQ ID NO: 274 - protein, 12 aa, Artificial Sequence
  synthetic polypeptide
ARAANWHDTHLD

SEQ ID NO: 275 - protein, 12 aa, Artificial Sequence
  synthetic polypeptide
ARAANWHDTALD

SEQ ID NO: 276 - protein, 12 aa, Artificial Sequence
  synthetic polypeptide
ARAANWHDTALD

SEQ ID NO: 277 - protein, 12 aa, Artificial Sequence
  synthetic polypeptide
ARAANWHDTALD

SEQ ID NO: 278 - protein, 12 aa, Artificial Sequence
  synthetic polypeptide
ARAANWHDTHLD

SEQ ID NO: 279 - protein, 12 aa, Artificial Sequence
  synthetic polypeptide
ARAANWHDTHLD

SEQ ID NO: 280 - protein, 12 aa, Artificial Sequence
  synthetic polypeptide
ARAANWHDTALD

SEQ ID NO: 281 - protein, 12 aa, Artificial Sequence
  synthetic polypeptide
ARAANWHDTALD

SEQ ID NO: 282 - protein, 12 aa, Artificial Sequence
  synthetic polypeptide
ARAANWHDTALD

SEQ ID NO: 283 - protein, 12 aa, Artificial Sequence
  synthetic polypeptide
ARAANWHDTALD

SEQ ID NO: 284 - protein, 12 aa, Artificial Sequence
  synthetic polypeptide
ARAANWHDTHLD

SEQ ID NO: 285 - protein, 12 aa, Artificial Sequence
  synthetic polypeptide
ARAANWHDTALD

SEQ ID NO: 286 - protein, 7 aa, Artificial Sequence
  synthetic polypeptide
LTYLNWY

SEQ ID NO: 287 - protein, 7 aa, Artificial Sequence
  synthetic polypeptide
LRYLNWY

SEQ ID NO: 288 - protein, 7 aa, Artificial Sequence
  synthetic polypeptide
LTYVNWY

SEQ ID NO: 289 - protein, 7 aa, Artificial Sequence
  synthetic polypeptide
STYVNWY

SEQ ID NO: 290 - protein, 7 aa, Artificial Sequence
  synthetic polypeptide
SSYLNWY

SEQ ID NO: 291 - protein, 7 aa, Artificial Sequence
  synthetic polypeptide
LSYVNWY

SEQ ID NO: 292 - protein, 7 aa, Artificial Sequence
  synthetic polypeptide
ISYVNWY

SEQ ID NO: 293 - protein, 7 aa, Artificial Sequence
  synthetic polypeptide
VSYLNWY

SEQ ID NO: 294 - protein, 7 aa, Artificial Sequence
  synthetic polypeptide
SSYLNWY

SEQ ID NO: 295 - protein, 7 aa, Artificial Sequence
  synthetic polypeptide
VSYVNWY

SEQ ID NO: 296 - protein, 7 aa, Artificial Sequence
  synthetic polypeptide
LTYLNWY

SEQ ID NO: 297 - protein, 7 aa, Artificial Sequence
  synthetic polypeptide
LTYVNWY

SEQ ID NO: 298 - protein, 7 aa, Artificial Sequence
  synthetic polypeptide
LSYVNWY

SEQ ID NO: 299 - protein, 7 aa, Artificial Sequence
  synthetic polypeptide
VSYLNWY

SEQ ID NO: 300 - protein, 7 aa, Artificial Sequence
  synthetic polypeptide
VSYVNWY

SEQ ID NO: 301 - protein, 7 aa, Artificial Sequence
  synthetic polypeptide
LSYVNWY

SEQ ID NO: 302 - protein, 7 aa, Artificial Sequence
  synthetic polypeptide
LSYLNWY

SEQ ID NO: 303 - protein, 7 aa, Artificial Sequence
  synthetic polypeptide
LSYVNWY

SEQ ID NO: 304 - protein, 7 aa, Artificial Sequence
  synthetic polypeptide
ISYLNWY

SEQ ID NO: 305 - protein, 7 aa, Artificial Sequence
  synthetic polypeptide
SSYVNWY

SEQ ID NO: 306 - protein, 7 aa, Artificial Sequence
  synthetic polypeptide
LTYLNWY

SEQ ID NO: 307 - protein, 7 aa, Artificial Sequence
  synthetic polypeptide
ISYVNWY

SEQ ID NO: 308 - protein, 7 aa, Artificial Sequence
  synthetic polypeptide
LSYVNWY

SEQ ID NO: 309 - protein, 7 aa, Artificial Sequence
  synthetic polypeptide
LTYLNWY

SEQ ID NO: 310 - protein, 7 aa, Artificial Sequence
  synthetic polypeptide
LTYLNWY

SEQ ID NO: 311 - protein, 7 aa, Artificial Sequence
  synthetic polypeptide
LTYVNWY

SEQ ID NO: 312 - protein, 7 aa, Artificial Sequence
  synthetic polypeptide
LTYLNWY

SEQ ID NO: 313 - protein, 7 aa, Artificial Sequence
  synthetic polypeptide
LSYLNWY

SEQ ID NO: 314 - protein, 7 aa, Artificial Sequence
  synthetic polypeptide
LTYVNWY

SEQ ID NO: 315 - protein, 7 aa, Artificial Sequence
  synthetic polypeptide
VSYVNWY

SEQ ID NO: 316 - protein, 7 aa, Artificial Sequence
  synthetic polypeptide
LSYLNWY

SEQ ID NO: 317 - protein, 7 aa, Artificial Sequence
  synthetic polypeptide
VSYVNWY

SEQ ID NO: 318 - protein, 7 aa, Artificial Sequence
  synthetic polypeptide
LTYVNWY

SEQ ID NO: 319 - protein, 7 aa, Artificial Sequence
  synthetic polypeptide
LSYLNWY

SEQ ID NO: 320 - protein, 7 aa, Artificial Sequence
  synthetic polypeptide
VSYLNWY

SEQ ID NO: 321 - protein, 7 aa, Artificial Sequence
  synthetic polypeptide
LSYVNWY

SEQ ID NO: 322 - protein, 7 aa, Artificial Sequence
  synthetic polypeptide
ISYLNWY

SEQ ID NO: 323 - protein, 7 aa, Artificial Sequence
  synthetic polypeptide
LSYVNWY

SEQ ID NO: 324 - protein, 7 aa, Artificial Sequence
  synthetic polypeptide
LSYVNWY

SEQ ID NO: 325 - protein, 7 aa, Artificial Sequence
  synthetic polypeptide
LTYLNWY

SEQ ID NO: 326 - protein, 7 aa, Artificial Sequence
  synthetic polypeptide
VTYVNWY

SEQ ID NO: 327 - protein, 7 aa, Artificial Sequence
  synthetic polypeptide
LTYLNWY

SEQ ID NO: 328 - protein, 7 aa, Artificial Sequence
  synthetic polypeptide
LSYLNWY

SEQ ID NO: 329 - protein, 7 aa, Artificial Sequence
  synthetic polypeptide
ISYLNWY

SEQ ID NO: 330 - protein, 7 aa, Artificial Sequence
  synthetic polypeptide
LSYLNWY

SEQ ID NO: 331 - protein, 7 aa, Artificial Sequence
  synthetic polypeptide
LTYVNWY

SEQ ID NO: 332 - protein, 7 aa, Artificial Sequence
  synthetic polypeptide
ISYVNWY

SEQ ID NO: 333 - protein, 7 aa, Artificial Sequence
  synthetic polypeptide
VSYLNWY

SEQ ID NO: 334 - protein, 7 aa, Artificial Sequence
  synthetic polypeptide
VSYVNWY

SEQ ID NO: 335 - protein, 7 aa, Artificial Sequence
  synthetic polypeptide
ISYLNWY

SEQ ID NO: 336 - protein, 7 aa, Artificial Sequence
  synthetic polypeptide
ISYVNWY

SEQ ID NO: 337 - protein, 7 aa, Artificial Sequence
  synthetic polypeptide
LTYLNWY

SEQ ID NO: 338 - protein, 7 aa, Artificial Sequence
  synthetic polypeptide
VSYLNWY

SEQ ID NO: 339 - protein, 7 aa, Artificial Sequence
  synthetic polypeptide
STYLNWY

SEQ ID NO: 340 - protein, 7 aa, Artificial Sequence
  synthetic polypeptide
LTYLNWY

SEQ ID NO: 341 - protein, 7 aa, Artificial Sequence
  synthetic polypeptide
LTYLNWY

SEQ ID NO: 342 - protein, 7 aa, Artificial Sequence
  synthetic polypeptide
SRYLNWY

SEQ ID NO: 343 - protein, 10 aa, Artificial Sequence
  synthetic polypeptide
LLIYAATSRH

SEQ ID NO: 344 - protein, 10 aa, Artificial Sequence
  synthetic polypeptide
LLIYAATSRA

SEQ ID NO: 345 - protein, 10 aa, Artificial Sequence
  synthetic polypeptide
LVIYATTSLA

SEQ ID NO: 346 - protein, 10 aa, Artificial Sequence
  synthetic polypeptide
LLIYAVTSLA

SEQ ID NO: 347 - protein, 10 aa, Artificial Sequence
  synthetic polypeptide
LVIYAVTSRA

SEQ ID NO: 348 - protein, 10 aa, Artificial Sequence
  synthetic polypeptide
LLIYAATSLA

SEQ ID NO: 349 - protein, 10 aa, Artificial Sequence
  synthetic polypeptide
LLIYAATSRA

SEQ ID NO: 350 - protein, 10 aa, Artificial Sequence
  synthetic polypeptide
LLIYAATSRA

SEQ ID NO: 351 - protein, 10 aa, Artificial Sequence
  synthetic polypeptide
LLIYAASSLQ

SEQ ID NO: 352 - protein, 10 aa, Artificial Sequence
  synthetic polypeptide
LLIYAATSRA

SEQ ID NO: 353 - protein, 10 aa, Artificial Sequence
  synthetic polypeptide
LVIYAATSLA

SEQ ID NO: 354 - protein, 10 aa, Artificial Sequence
  synthetic polypeptide
LLIYAATSRA

SEQ ID NO: 355 - protein, 10 aa, Artificial Sequence
  synthetic polypeptide
LLIYAATSRA

SEQ ID NO: 356 - protein, 10 aa, Artificial Sequence
  synthetic polypeptide
LVIYAATSRA

SEQ ID NO: 357 - protein, 10 aa, Artificial Sequence
  synthetic polypeptide
LVIYAATSRA

SEQ ID NO: 358 - protein, 10 aa, Artificial Sequence
  synthetic polypeptide
LVIYAATSRA

SEQ ID NO: 359 - protein, 10 aa, Artificial Sequence
  synthetic polypeptide
LVIYAATSRA

SEQ ID NO: 360 - protein, 10 aa, Artificial Sequence
  synthetic polypeptide
LVIYAATSRH

SEQ ID NO: 361 - protein, 10 aa, Artificial Sequence
  synthetic polypeptide
LLIYAATSRA

SEQ ID NO: 362 - protein, 10 aa, Artificial Sequence
  synthetic polypeptide
LLIYAVTSRA

SEQ ID NO: 363 - protein, 10 aa, Artificial Sequence
  synthetic polypeptide
LVIYAATSRA

SEQ ID NO: 364 - protein, 10 aa, Artificial Sequence
  synthetic polypeptide
LVIYAATSRA

SEQ ID NO: 365 - protein, 10 aa, Artificial Sequence
  synthetic polypeptide
LLIYAATSRH

SEQ ID NO: 366 - protein, 10 aa, Artificial Sequence
  synthetic polypeptide
LVIYAATSRA

SEQ ID NO: 367 - protein, 10 aa, Artificial Sequence
  synthetic polypeptide
LVIYAATSLA

SEQ ID NO: 368 - protein, 10 aa, Artificial Sequence
  synthetic polypeptide
LVIYAATSRA

SEQ ID NO: 369 - protein, 10 aa, Artificial Sequence
  synthetic polypeptide
LVIYAATSRA

SEQ ID NO: 370 - protein, 10 aa, Artificial Sequence
  synthetic polypeptide
LLIYAASSLQ

SEQ ID NO: 371 - protein, 10 aa, Artificial Sequence
  synthetic polypeptide
LLIYAATSLA

SEQ ID NO: 372 - protein, 10 aa, Artificial Sequence
  synthetic polypeptide
LLIYAATSLA

SEQ ID NO: 373 - protein, 10 aa, Artificial Sequence
  synthetic polypeptide
LLIYAASSLQ

SEQ ID NO: 374 - protein, 10 aa, Artificial Sequence
  synthetic polypeptide
LLIYAATSRA

SEQ ID NO: 375 - protein, 10 aa, Artificial Sequence
  synthetic polypeptide
LVIYAATSLA

SEQ ID NO: 376 - protein, 10 aa, Artificial Sequence
  synthetic polypeptide
LVIYAATSRA

SEQ ID NO: 377 - protein, 10 aa, Artificial Sequence
  synthetic polypeptide
LLIYATTSRA

SEQ ID NO: 378 - protein, 10 aa, Artificial Sequence
  synthetic polypeptide
LLIYVASSRA

SEQ ID NO: 379 - protein, 10 aa, Artificial Sequence
  synthetic polypeptide
LVIYAATSLA

SEQ ID NO: 380 - protein, 10 aa, Artificial Sequence
  synthetic polypeptide
LLIYAATSRA

SEQ ID NO: 381 - protein, 10 aa, Artificial Sequence
  synthetic polypeptide
LLIYAATSRH

SEQ ID NO: 382 - protein, 10 aa, Artificial Sequence
  synthetic polypeptide
LLIYAVTSRA

SEQ ID NO: 383 - protein, 10 aa, Artificial Sequence
  synthetic polypeptide
LVIYAATSRA

SEQ ID NO: 384 - protein, 10 aa, Artificial Sequence
  synthetic polypeptide
LVIYAATSRA

SEQ ID NO: 385 - protein, 10 aa, Artificial Sequence
  synthetic polypeptide
LLIYAATSRA

SEQ ID NO: 386 - protein, 10 aa, Artificial Sequence
  synthetic polypeptide
LVIYAATSLA

SEQ ID NO: 387 - protein, 10 aa, Artificial Sequence
  synthetic polypeptide
LVIYAATSRA

SEQ ID NO: 388 - protein, 10 aa, Artificial Sequence
  synthetic polypeptide
LVIYAATSLA

SEQ ID NO: 389 - protein, 10 aa, Artificial Sequence
  synthetic polypeptide
LVIYAATSRA

SEQ ID NO: 390 - protein, 10 aa, Artificial Sequence
  synthetic polypeptide
LVIYAATSRA

SEQ ID NO: 391 - protein, 10 aa, Artificial Sequence
  synthetic polypeptide
LLIYAATSRH

SEQ ID NO: 392 - protein, 10 aa, Artificial Sequence
  synthetic polypeptide
LLIYAATSRA

SEQ ID NO: 393 - protein, 10 aa, Artificial Sequence
  synthetic polypeptide
LVIYAATSRA

SEQ ID NO: 394 - protein, 10 aa, Artificial Sequence
  synthetic polypeptide
LVIYYVNNLP

SEQ ID NO: 395 - protein, 10 aa, Artificial Sequence
  synthetic polypeptide
LLIYYVTNLA

SEQ ID NO: 396 - protein, 10 aa, Artificial Sequence
  synthetic polypeptide
LVIYAASSLQ

SEQ ID NO: 397 - protein, 10 aa, Artificial Sequence
  synthetic polypeptide
LVIYAATSRA

SEQ ID NO: 398 - protein, 10 aa, Artificial Sequence
  synthetic polypeptide
LLIYAATSRH

SEQ ID NO: 399 - protein, 10 aa, Artificial Sequence
  synthetic polypeptide
LVIYAATSLA

SEQ ID NO: 400 - protein, 8 aa, Artificial Sequence
  synthetic polypeptide
QQSDESPL

SEQ ID NO: 401 - protein, 8 aa, Artificial Sequence
  synthetic polypeptide
QQSDNLPL

SEQ ID NO: 402 - protein, 8 aa, Artificial Sequence
  synthetic polypeptide
QQSYNTPL

SEQ ID NO: 403 - protein, 8 aa, Artificial Sequence
  synthetic polypeptide
QQSYDNPL

SEQ ID NO: 404 - protein, 8 aa, Artificial Sequence
  synthetic polypeptide
QQSYDLPL

SEQ ID NO: 405 - protein, 8 aa, Artificial Sequence
  synthetic polypeptide
QQSYELPL

SEQ ID NO: 406 - protein, 8 aa, Artificial Sequence
  synthetic polypeptide
QQSYNTPL

SEQ ID NO: 407 - protein, 8 aa, Artificial Sequence
  synthetic polypeptide
QQSYDNPL

SEQ ID NO: 408 - protein, 8 aa, Artificial Sequence
  synthetic polypeptide
QQSYSTPL

SEQ ID NO: 409 - protein, 8 aa, Artificial Sequence
  synthetic polypeptide
QQSYDLPL

SEQ ID NO: 410 - protein, 8 aa, Artificial Sequence
  synthetic polypeptide
QQSDDSPL

SEQ ID NO: 411 - protein, 8 aa, Artificial Sequence
  synthetic polypeptide
QQSYENPL

SEQ ID NO: 412 - protein, 8 aa, Artificial Sequence
  synthetic polypeptide
QQSYDLPL

SEQ ID NO: 413 - protein, 8 aa, Artificial Sequence
  synthetic polypeptide
QQSYDTPL

SEQ ID NO: 414 - protein, 8 aa, Artificial Sequence
  synthetic polypeptide
QQSYDNPL

SEQ ID NO: 415 - protein, 8 aa, Artificial Sequence
  synthetic polypeptide
QQSYENPL

SEQ ID NO: 416 - protein, 8 aa, Artificial Sequence
  synthetic polypeptide
QQSYSTPL

SEQ ID NO: 417 - protein, 8 aa, Artificial Sequence
  synthetic polypeptide
QQSYNTPL

SEQ ID NO: 418 - protein, 8 aa, Artificial Sequence
  synthetic polypeptide
QQSYDSPL

SEQ ID NO: 419 - protein, 8 aa, Artificial Sequence
  synthetic polypeptide
QQSYDSPL

SEQ ID NO: 420 - protein, 8 aa, Artificial Sequence
  synthetic polypeptide
QQSYDNPL

SEQ ID NO: 421 - protein, 8 aa, Artificial Sequence
  synthetic polypeptide
QQSYDTPL

SEQ ID NO: 422 - protein, 8 aa, Artificial Sequence
  synthetic polypeptide
QQSYNSPL

SEQ ID NO: 423 - protein, 8 aa, Artificial Sequence
  synthetic polypeptide
QQSYDSPL

SEQ ID NO: 424 - protein, 8 aa, Artificial Sequence
  synthetic polypeptide
QHSYENPL

SEQ ID NO: 425 - protein, 8 aa, Artificial Sequence
  synthetic polypeptide
QQSYENPL

SEQ ID NO: 426 - protein, 8 aa, Artificial Sequence
  synthetic polypeptide
QQSDELPL

SEQ ID NO: 427 - protein, 8 aa, Artificial Sequence
  synthetic polypeptide
QQSYDSPL

SEQ ID NO: 428 - protein, 8 aa, Artificial Sequence
  synthetic polypeptide
QQSYDLPL

SEQ ID NO: 429 - protein, 8 aa, Artificial Sequence
  synthetic polypeptide
QQSYDNPL

SEQ ID NO: 430 - protein, 8 aa, Artificial Sequence
  synthetic polypeptide
QQSYSLPL

SEQ ID NO: 431 - protein, 8 aa, Artificial Sequence
  synthetic polypeptide
QQSYDTPL

SEQ ID NO: 432 - protein, 8 aa, Artificial Sequence
  synthetic polypeptide
QQSYELPL

SEQ ID NO: 433 - protein, 8 aa, Artificial Sequence
  synthetic polypeptide
QQSYDSPL

SEQ ID NO: 434 - protein, 8 aa, Artificial Sequence
  synthetic polypeptide
QQSYDTPL

SEQ ID NO: 435 - protein, 8 aa, Artificial Sequence
  synthetic polypeptide
QQSYSLPL

SEQ ID NO: 436 - protein, 8 aa, Artificial Sequence
  synthetic polypeptide
QQSYSSPL

SEQ ID NO: 437 - protein, 8 aa, Artificial Sequence
  synthetic polypeptide
QQSYSTPL

SEQ ID NO: 438 - protein, 8 aa, Artificial Sequence
  synthetic polypeptide
QQSYSLPL

SEQ ID NO: 439 - protein, 8 aa, Artificial Sequence
  synthetic polypeptide
QQSYDTPL

SEQ ID NO: 440 - protein, 8 aa, Artificial Sequence
  synthetic polypeptide
QQSYDSPL

SEQ ID NO: 441 - protein, 8 aa, Artificial Sequence
  synthetic polypeptide
QQSYELPL

SEQ ID NO: 442 - protein, 8 aa, Artificial Sequence
  synthetic polypeptide
QQSYELPL

SEQ ID NO: 443 - protein, 8 aa, Artificial Sequence
  synthetic polypeptide
QQSYENPL

SEQ ID NO: 444 - protein, 8 aa, Artificial Sequence
  synthetic polypeptide
QQSYNSPL

SEQ ID NO: 445 - protein, 8 aa, Artificial Sequence
  synthetic polypeptide
QQSYDTPL

SEQ ID NO: 446 - protein, 8 aa, Artificial Sequence
  synthetic polypeptide
QQSYDLPL

SEQ ID NO: 447 - protein, 8 aa, Artificial Sequence
  synthetic polypeptide
QQSYDSPL

SEQ ID NO: 448 - protein, 8 aa, Artificial Sequence
  synthetic polypeptide
  misc_feature (5)..(5): Xaa can be any naturally occurring amino acid
QQSYXNPL

SEQ ID NO: 449 - protein, 8 aa, Artificial Sequence
  synthetic polypeptide
QQSYDSPL

SEQ ID NO: 450 - protein, 8 aa, Artificial Sequence
  synthetic polypeptide
QQSYDTPL

SEQ ID NO: 451 - protein, 8 aa, Artificial Sequence
  synthetic polypeptide
QQSYNSPL

SEQ ID NO: 452 - protein, 8 aa, Artificial Sequence
  synthetic polypeptide
QQSYDNPL

SEQ ID NO: 453 - protein, 8 aa, Artificial Sequence
  synthetic polypeptide
QQSYSTPL

SEQ ID NO: 454 - protein, 8 aa, Artificial Sequence
  synthetic polypeptide
QQSDELPL

SEQ ID NO: 455 - protein, 8 aa, Artificial Sequence
  synthetic polypeptide
QQSYSNPL

SEQ ID NO: 456 - protein, 8 aa, Artificial Sequence
  synthetic polypeptide
QQSYDNPL

SEQ ID NO: 457 - protein, 120 aa, Artificial Sequence
  synthetic polypeptide
EVQLLESGGGLVQPGGSLRLSCAASGFTFSSYGMHWVRQAPGKGLEWVSSINYNGGYTSYADSVKGRFTISRDNSKNTLYLQMNSLRAEDTAVYYCARAATWHDTHLDYWGQGTLVTVSS

SEQ ID NO: 458 - protein, 120 aa, Artificial Sequence
  synthetic polypeptide
EVQLLESGGGLVQPGGSLRLSCAASGFTFDSYGMNWVRQAPGKGLEWVSNINYNSGYKGYADSVKGRFTISRDNSKNTLYLQMNSLRAEDTAVYYCARAATWHDTHLDYWGQGTLVTVSS

SEQ ID NO: 459 - protein, 120 aa, Artificial Sequence
  synthetic polypeptide
EVQLLESGGGLVQPGGSLRLSCAASGFTFSDYGMHWVRQAPGKGLEWVSGINYNGGYTSYADSVKGRFTISRDNSKNTLYLQMNSLRAEDTAVYYCARAATWHDTHLDYWGQGTLVTVSS

SEQ ID NO: 460 - protein, 120 aa, Artificial Sequence
  synthetic polypeptide
EVQLLESGGGLVQPGGSLRLSCAASGFTFDDYSMHWVRQAPGKGLEWVASINYNGGYKSYADSVKGRFTISRDNSKNTLYLQMNSLRAEDTAVYYCARAATWHDTHLDYWGQGTLVTVSS

SEQ ID NO: 461 - protein, 120 aa, Artificial Sequence
  synthetic polypeptide
EVQLLESGGGLVQPGGSLRLSCAASGFTFDSYSMHWVRQAPGKGLEWVSSINYNGGYTSYADSVKGRFTISRDNSKNTLYLQMNSLRAEDTAVYYCARAATWHDTHLDYWGQGTLVTVSS

SEQ ID NO: 462 - protein, 120 aa, Artificial Sequence
  synthetic polypeptide
EVQLLESGGGLVQPGGSLRLSCAASGFTFDSYGMNWVRQAPGKGLEWVSGINYNGGYTGYADSVKGRFTISRDNSKNTLYLQMNSLRAEDTAVYYCARAATWHDTHLDYWGQGTLVTVSS

SEQ ID NO: 463 - protein, 120 aa, Artificial Sequence
  synthetic polypeptide
EVQLLESGGGLVQPGGSLRLSCAASGFTFDDYGMHWVRQAPGKGLEWVSGINYNGGYTSYADSVKGRFTISRDNSKNTLYLQMNSLRAEDTAVYYCARAATWHDTHLDYWGQGTLVTVSS

SEQ ID NO: 464 - protein, 120 aa, Artificial Sequence
  synthetic polypeptide
EVQLLESGGGLVQPGGSLRLSCAASGFTFDSYGMHWVRQAPGKGLEWVAGINYNGGYTSYADSVKGRFTISRDNSKNTLYLQMNSLRAEDTAVYYCARAATWHDTHLDYWGQGTLVTVSS

SEQ ID NO: 465 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARAATWHDTHLDYWGQGTLVTVSS

SEQ ID NO: 466 - protein, 120 aa, Artificial Sequence
  synthetic polypeptide
EVQLLESGGGLVQPGGSLRLSCAASGFTFSDYGMHWVRQAPGKGLEWVSSINYNSGYKSYADSVKGRFTISRDNSKNTLYLQMNSLRAEDTAVYYCARAATWHDTHLDYWGQGTLVTVSS

SEQ ID NO: 467 - protein, 120 aa, Artificial Sequence
  synthetic polypeptide
EVQLLESGGGLVQPGGSLRLSCAASGFTFDDYGMHWVRQAPGKGLEWVSSINYNGGYTGYADSVKGRFTISRDNSKNTLYLQMNSLRAEDTAVYYCARAATWHDTHLDYWGQGTLVTVSS

SEQ ID NO: 468 - protein, 120 aa, Artificial Sequence
  synthetic polypeptide
EVQLLESGGGLVQPGGSLRLSCAASGFTFDSYGMHWVRQAPGKGLEWVAGINYNGGYTSYADSVKGRFTISRDNSKNTLYLQMNSLRAEDTAVYYCARAATWHDTALDYWGQGTLVTVSS

SEQ ID NO: 469 - protein, 120 aa, Artificial Sequence
  synthetic polypeptide
EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARAATWHDTHLDYWGQGTLVTVSS

SEQ ID NO: 470 - protein, 120 aa, Artificial Sequence
  synthetic polypeptide
EVQLLESGGGLVQPGGSLRLSCAASGFTFDDYSMHWVRQAPGKGLEWVANINYNGGYTSYADSVKGRFTISRDNSKNTLYLQMNSLRAEDTAVYYCARAATWHDTHLDYWGQGTLVTVSS

SEQ ID NO: 471 - protein, 120 aa, Artificial Sequence
  synthetic polypeptide
EVQLLESGGGLVQPGGSLRLSCAASGFTFDSYSMHWVRQAPGKGLEWVASINYNGGYKSYADSVKGRFTISRDNSKNTLYLQMNSLRAEDTAVYYCARAATWHDTHLDYWGQGTLVTVSS

SEQ ID NO: 472 - protein, 120 aa, Artificial Sequence
  synthetic polypeptide
EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARAATWHDTHLDYWGQGTLVTVSS

SEQ ID NO: 473 - protein, 120 aa, Artificial Sequence
  synthetic polypeptide
EVQLLESGGGLVQPGGSLRLSCAASGFTFSDYGMNWVRQAPGKGLEWVASINYNGGYTSYADSVKGRFTISRDNSKNTLYLQMNSLRAEDTAVYYCARAATWHDTHLDYWGQGTLVTVSS

SEQ ID NO: 474 - protein, 120 aa, Artificial Sequence
  synthetic polypeptide
EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARAATWHDTHLDYWGQGTLVTVSS

SEQ ID NO: 475 - protein, 120 aa, Artificial Sequence
  synthetic polypeptide
EVQLLESGGGLVQPGGSLRLSCAASGFTFSSYGMHWVRQAPGKGLEWVSSINYNSGYTSYADSVKGRFTISRDNSKNTLYLQMNSLRAEDTAVYYCARAATWHDTHLDYWGQGTLVTVSS

SEQ ID NO: 476 - protein, 120 aa, Artificial Sequence
  synthetic polypeptide
EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARAATWHDTHLDYWGQGTLVTVSS

SEQ ID NO: 477 - protein, 120 aa, Artificial Sequence
  synthetic polypeptide
EVQLLESGGGLVQPGGSLRLSCAASGFTFDSYSMHWVRQAPGKGLEWVANINYNGGYTSYADSVKGRFTISRDNSKNTLYLQMNSLRAEDTAVYYCARAATWHDTHLDYWGQGTLVTVSS

SEQ ID NO: 478 - protein, 120 aa, Artificial Sequence; identical to SEQ ID NO: 465
  synthetic polypeptide

SEQ ID NO: 479 - protein, 120 aa, Artificial Sequence
  synthetic polypeptide
EVQLLESGGGLVQPGGSLRLSCAASGFTFDSYGMNWVRQAPGKGLEWVSSINYNGGYTSYADSVKGRFTISRDNSKNTLYLQMNSLRAEDTAVYYCARAATWHDTHLDYWGQGTLVTVSS

SEQ ID NO: 480 - protein, 120 aa, Artificial Sequence; identical to SEQ ID NO: 469
  synthetic polypeptide

SEQ ID NO: 481 - protein, 120 aa, Artificial Sequence
  synthetic polypeptide
EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCARAATWHDTHLDYWGQGTLVTVSS

SEQ ID NO: 482 - protein, 120 aa, Artificial Sequence
  synthetic polypeptide
EVQLLESGGGLVQPGGSLRLSCAASGFTFDSYGMHWVRQAPGKGLEWVSNINYNGGYTSYADSVKGRFTISRDNSKNTLYLQMNSLRAEDTAVYYCARAATWHDTHLDYWGQGTLVTVSS

SEQ ID NO: 483 - protein, 120 aa, Artificial Sequence
  synthetic polypeptide
EVQLLESGGGLVQPGGSLRLSCAASGFTFSSYGMHWVRQAPGKGLEWVAGINYNSGYTSYADSVKGRFTISRDNSKNTLYLQMNSLRAEDTAVYYCARAATWHDTHLDYWGQGTLVTVSS

SEQ ID NO: 484 - protein, 120 aa, Artificial Sequence
  synthetic polypeptide
EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARAATWHDTHLDYWGQGTLVTVSS

SEQ ID NO: 485 - protein, 120 aa, Artificial Sequence
  synthetic polypeptide
EVQLLESGGGLVQPGGSLRLSCAASGFTFSDYSMHWVRQAPGKGLEWVASINYNGGYTSYADSVKGRFTISRDNSKNTLYLQMNSLRAEDTAVYYCARAATWHDTHLDYWGQGTLVTVSS

SEQ ID NO: 486 - protein, 120 aa, Artificial Sequence
  synthetic polypeptide
EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARAATWHDTHLDYWGQGTLVTVSS

SEQ ID NO: 487 - protein, 120 aa, Artificial Sequence
  synthetic polypeptide
EVQLLESGGGLVQPGGSLRLSCAASGFTFDSYGMHWVRQAPGKGLEWVASINYNGGYTGYADSVKGRFTISRDNSKNTLYLQMNSLRAEDTAVYYCARAATWHDTHLDYWGQGTLVTVSS

SEQ ID NO: 488 - protein, 120 aa, Artificial Sequence
  synthetic polypeptide
EVQLLESGGGLVQPGGSLRLSCAASGFTFDSYSMHWVRQAPGKGLEWVSSINYNGGYKSYADSVKGRFTISRDNSKNTLYLQMNSLRAEDTAVYYCARAATWHDTHLDYWGQGTLVTVSS

SEQ ID NO: 489 - protein, 120 aa, Artificial Sequence
  synthetic polypeptide
EVQLLESGGGLVQPGGSLRLSCAASGFTFDSYGMHWVRQAPGKGLEWVANINYNSGYTGYADSVKGRFTISRDNSKNTLYLQMNSLRAEDTAVYYCARAATWHDTHLDYWGQGTLVTVSS

SEQ ID NO: 490 - protein, 120 aa, Artificial Sequence
  synthetic polypeptide
EVQLLESGGGLVQPGGSLRLSCAASGFTFDSYGMHWVRQAPGKGLEWVSGINYNSGYKSYADSVKGRFTISRDNSKNTLYLQMNSLRAEDTAVYYCARAATWHDTALDYWGQGTLVTVSS

SEQ ID NO: 491 - protein, 120 aa, Artificial Sequence
  synthetic polypeptide
EVQLLESGGGLVQPGGSLRLSCAASGFTFDDYSMHWVRQAPGKGLEWVASINYNGGYTGYADSVKGRFTISRDNSKNTLYLQMNSLRAEDTAVYYCARAATWHDTHLDYWGQGTLVTVSS

SEQ ID NO: 492 - protein, 120 aa, Artificial Sequence
  synthetic polypeptide
EVQLLESGGGLVQPGGSLRLSCAASGFTFDSYGMHWVRQAPGKGLEWVASINYNGGYKSYADSVKGRFTISRDNSKNTLYLQMNSLRAEDTAVYYCARAATWHDTHLDYWGQGTLVTVSS

SEQ ID NO: 493 - protein, 120 aa, Artificial Sequence
  synthetic polypeptide
EVQLLESGGGLVQPGGSLRLSCAASGFTFSSYSMHWVRQAPGKGLEWVASINYNSGYTGYADSVKGRFTISRDNSKNTLYLQMNSLRAEDTAVYYCARAATWHDTHLDYWGQGTLVTVSS

SEQ ID NO: 494 - protein, 120 aa, Artificial Sequence
  synthetic polypeptide
EVQLLESGGGLVQPGGSLRLSCAASGFTFDSYGMHWVRQAPGKGLEWVANINYNGGYKSYADSVKGRFTISRDNSKNTLYLQMNSLRAEDTAVYYCARAATWHDTHLDYWGQGTLVTVSS

SEQ ID NO: 495 - protein, 120 aa, Artificial Sequence; identical to SEQ ID NO: 469
  synthetic polypeptide

SEQ ID NO: 496 - protein, 120 aa, Artificial Sequence
  synthetic polypeptide
EVQLLESGGGLVQPGGSLRLSCAASGFTFSSYSMHWVRQAPGKGLEWVSSINYNGGYKSYADSVKGRFTISRDNSKNTLYLQMNSLRAEDTAVYYCARAATWHDTHLDYWGQGTLVTVSS

SEQ ID NO: 497 - protein, 120 aa, Artificial Sequence; identical to SEQ ID NO: 474
  synthetic polypeptide

SEQ ID NO: 498 - protein, 120 aa, Artificial Sequence
  synthetic polypeptide
EVQLLESGGGLVQPGGSLRLSCAASGFTFSDYGMHWVRQAPGKGLEWVAGINYNGGYTGYADSVKGRFTISRDNSKNTLYLQMNSLRAEDTAVYYCARAATWHDTHLDYWGQGTLVTVSS

SEQ ID NO: 499 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARAATWHDTHLDYWGQGTLVTVSS

SEQ ID NO: 500 - protein, 120 aa, Artificial Sequence; identical to SEQ ID NO: 499
  synthetic polypeptide

SEQ ID NO: 501 - protein, 120 aa, Artificial Sequence
  synthetic polypeptide
EVQLLESGGGLVQPGGSLRLSCAASGFTFSSYGMHWVRQAPGKGLEWVANINYNSGYKSYADSVKGRFTISRDNSKNTLYLQMNSLRAEDTAVYYCARAATWHDTHLDYWGQGTLVTVSS

SEQ ID NO: 502 - protein, 120 aa, Artificial Sequence; identical to SEQ ID NO: 464
  synthetic polypeptide

SEQ ID NO: 503 - protein, 120 aa, Artificial Sequence
  synthetic polypeptide
EVQLLESGGGLVQPGGSLRLSCAASGFTFSSYGMHWVRQAPGKGLEWVSNINYNGGYTSYADSVKGRFTISRDNSKNTLYLQMNSLRAEDTAVYYCARAATWHDTHLDYWGQGTLVTVSS

SEQ ID NO: 504 - protein, 120 aa, Artificial Sequence
  synthetic polypeptide
EVQLLESGGGLVQPGGSLRLSCAASGFTFSSYGMHWVRQAPGKGLEWVSNINYNGGYKSYADSVKGRFTISRDNSKNTLYLQMNSLRAEDTAVYYCARAATWHDTHLDYWGQGTLVTVSS

SEQ ID NO: 505 - protein, 120 aa, Artificial Sequence
  synthetic polypeptide
EVQLLESGGGLVQPGGSLRLSCAASGFTFDSYGMNWVRQAPGKGLEWVSNINYNGGYTSYADSVKGRFTISRDNSKNTLYLQMNSLRAEDTAVYYCARAATWHDTHLDYWGQGTLVTVSS

SEQ ID NO: 506 - protein, 120 aa, Artificial Sequence
  synthetic polypeptide
EVQLLESGGGLVQPGGSLRLSCAASGFTFSSYSMHWVRQAPGKGLEWVASINYNSGYTSYADSVKGRFTISRDNSKNTLYLQMNSLRAEDTAVYYCARAATWHDTHLDYWGQGTLVTVSS

SEQ ID NO: 507 - protein, 120 aa, Artificial Sequence
  synthetic polypeptide
EVQLLESGGGLVQPGGSLRLSCAASGFTFDSYGMHWVRQAPGKGLEWVAGINYNSGYTGYADSVKGRFTISRDNSKNTLYLQMNSLRAEDTAVYYCARAATWHDTHLDYWGQGTLVTVSS

SEQ ID NO: 508 - protein, 120 aa, Artificial Sequence; identical to SEQ ID NO: 463
  synthetic polypeptide

SEQ ID NO: 509 - protein, 120 aa, Artificial Sequence; identical to SEQ ID NO: 499
  synthetic polypeptide

SEQ ID NO: 510 - protein, 120 aa, Artificial Sequence
  synthetic polypeptide
EVQLLESGGGLVQPGGSLRLSCAASGFTFSDYGMHWVRQAPGKGLEWVAGINYNGGYTSYADSVKGRFTISRDNSKNTLYLQMNSLRAEDTAVYYCARAATWHDTHLDYWGQGTLVTVSS

SEQ ID NO: 511 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARAATWHDTHLDYWGQGTLVTVSS

SEQ ID NO: 512 - protein, 120 aa, Artificial Sequence
  synthetic polypeptide
EVQLLESGGGLVQPGGSLRLSCAASGFTFDSYGMHWVRQAPGKGLEWVSGINYNGGYKSYADSVKGRFTISRDNSKNTLYLQMNSLRAEDTAVYYCARAATWHDTHLDYWGQGTLVTVSS

SEQ ID NO: 513 - protein, 120 aa, Artificial Sequence; identical to SEQ ID NO: 499
  synthetic polypeptide

SEQ ID NO: 514 - protein, 120 aa, Artificial Sequence
  synthetic polypeptide
EVQLLESGGGLVQPGGSLRLSCAASGFTFSSYGMHWVRQAPGKGLEWVASINYNSGYTGYADSVKGRFTISRDNSKNTLYLQMNSLRAEDTAVYYCARAATWHDTHLDYWGQGTLVTVSS

SEQ ID NO: 515 - protein, 120 aa, Artificial Sequence; identical to SEQ ID NO: 472
  synthetic polypeptide

SEQ ID NO: 516 - protein, 120 aa, Artificial Sequence; identical to SEQ ID NO: 469
  synthetic polypeptide

SEQ ID NO: 517 - protein, 120 aa, Artificial Sequence
  synthetic polypeptide
EVQLLESGGGLVQPGGSLRLSCAASGFTFDSYGMHWVRQAPGKGLEWVAGINYNSGYTSYADSVKGRFTISRDNSKNTLYLQMNSLRAEDTAVYYCARAATWHDTHLDYWGQGTLVTVSS

SEQ ID NO: 518 - protein, 120 aa, Artificial Sequence
  synthetic polypeptide
EVQLLESGGGLVQPGGSLRLSCAASGFTFSSYGMHWVRQAPGKGLEWVSSINYNGGYKSYADSVKGRFTISRDNSKNTLYLQMNSLRAEDTAVYYCARAATWHDTHLDYWGQGTLVTVSS

SEQ ID NO: 519 - protein, 120 aa, Artificial Sequence; identical to SEQ ID NO: 465
  synthetic polypeptide

SEQ ID NO: 520 - protein, 120 aa, Artificial Sequence
  synthetic polypeptide
EVQLLESGGGLVQPGGSLRLSCAASGFTFDSYSMHWVRQAPGKGLEWVSGINYNGGYTSYADSVKGRFTISRDNSKNTLYLQMNSLRAEDTAVYYCARAATWHDTHLDYWGQGTLVTVSS

SEQ ID NO: 521 - protein, 120 aa, Artificial Sequence
  synthetic polypeptide
  misc_feature (30)..(30): Xaa can be any naturally occurring amino acid
EVQLLESGGGLVQPGGSLRLSCAASGFTFXSYGMNWVRQAPGKGLEWVASINYNGGYKGYADSVKGRFTISRDNSKNTLYLQMNSLRAEDTAVYYCARAATWHDTHLDYWGQGTLVTVSS

SEQ ID NO: 522 - protein, 120 aa, Artificial Sequence
  synthetic polypeptide
EVQLLESGGGLVQPGGSLRLSCAASGFTFSSYSMNWVRQAPGKGLEWVSNINYNGGYTSYADSVKGRFTISRDNSKNTLYLQMNSLRAEDTAVYYCARAATWHDTHLDYWGQGTLVTVSS

SEQ ID NO: 523 - protein, 120 aa, Artificial Sequence; identical to SEQ ID NO: 472
  synthetic polypeptide

SEQ ID NO: 524 - protein, 120 aa, Artificial Sequence
  synthetic polypeptide
EVQLLESGGGLVQPGGSLRLSCAASGFTFSSYGMHWVRQAPGKGLEWVAGINYNSGYTGYADSVKGRFTISRDNSKNTLYLQMNSLRAEDTAVYYCARAATWHDTHLDYWGQGTLVTVSS

SEQ ID NO: 525 - protein, 120 aa, Artificial Sequence
  synthetic polypeptide
EVQLLESGGGLVQPGGSLRLSCAASGFTFDSYGMNWVRQAPGKGLEWVANINYNSGYKSYADSVKGRFTISRDNSKNTLYLQMNSLRAEDTAVYYCARAATWHDTALDYWGQGTLVTVSS

SEQ ID NO: 526 - protein, 120 aa, Artificial Sequence; identical to SEQ ID NO: 488
  synthetic polypeptide

SEQ ID NO: 527 - protein, 120 aa, Artificial Sequence
  synthetic polypeptide
EVQLLESGGGLVQPGGSLRLSCAASGFTFSDYGMHWVRQAPGKGLEWVASINYNGGYTSYADSVKGRFTISRDNSKNTLYLQMNSLRAEDTAVYYCARAATWHDTHLDYWGQGTLVTVSS

SEQ ID NO: 528 - protein, 107 aa, Artificial Sequence [sequence omitted]

SEQ ID NO: 529 - protein, 107 aa, Artificial Sequence
  synthetic polypeptide
DIQMTQSPSSLSASVGDRVTITCRASQSIVTYLNWYQQKPGKAPKLLIYAATSRASGVPSRFSGSGSGTDFTLTISSLQPEDFATYYCQQSYSSPLTFGGGTKVEIK

SEQ ID NO: 530 - protein, 107 aa, Artificial Sequence
  synthetic polypeptide
DIQMTQSPSSLSASVGDRVTITCRASQSISTYVNWYQQKPGKAPKLLIYAVTSLHSGVPSRFSGSGSGTDFTLTISSLQPEDFATYYCQQSYDNPLTFGGGTKVEIK

SEQ ID NO: 531 - protein, 107 aa, Artificial Sequence; identical to SEQ ID NO: 105
  synthetic polypeptide

SEQ ID NO: 532 - protein, 107 aa, Artificial Sequence
  synthetic polypeptide
DIQMTQSPSSLSASVGDRVTITCRASQSIITYVNWYQQKPGKAPKLLIYAATSRASGVPSRFSGSGSGTDFTLTISSLQPEDFATYYCQQSYDTPLTFGGGTKVEIK

SEQ ID NO: 533 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYNTPLTFGGGTKVEIK

SEQ ID NO: 534 - protein, 107 aa, Artificial Sequence
  synthetic polypeptide
DIQMTQSPSSLSASVGDRVTITCRASQSIVTYVNWYQQKPGKAPKLLIYAATSRASGVPSRFSGSGSGTDFTLTISSLQPEDFATYYCQQSYELPLTFGGGTKVEIK

SEQ ID NO: 535 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSDSTPLTFGGGTKVEIK

SEQ ID NO: 536 - protein, 107 aa, Artificial Sequence
  synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYETPLTFGGGTKVEIK

SEQ ID NO: 537 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSYDSPLTFGGGTKVEIK

SEQ ID NO: 538 - protein, 107 aa, Artificial Sequence
  synthetic polypeptide
DIQMTQSPSSLSASVGDRVTITCRASQSIISYLNWYQQKPGKAPKLVIYAATSRASGVPSRFSGSGSGTDFTLTISSLQPEDFATYYCQQSYDSPLTFGGGTKVEIK

SEQ ID NO: 539 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSDNSPLTFGGGTKVEIK

SEQ ID NO: 540 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSDDNPLTFGGGTKVEIK

SEQ ID NO: 541 - protein, 107 aa, Artificial Sequence
  synthetic polypeptide
DIQMTQSPSSLSASVGDRVTITCRASQSILTYLNWYQQKPGKAPKLVIYATTSRHSGVPSRFSGSGSGTDFTLTISSLQPEDFATYYCQQSYESPLTFGGGTKVEIK

SEQ ID NO: 542 - protein, 107 aa, Artificial Sequence
  synthetic polypeptide
DIQMTQSPSSLSASVGDRVTITCRASQSILTYLNWYQQKPGKAPKLVIYAATSLHSGVPSRFSGSGSGTDFTLTISSLQPEDFATYYCQQSYDTPLTFGGGTKVEIK

SEQ ID NO: 543 - protein, 107 aa, Artificial Sequence
  synthetic polypeptide
DIQMTQSPSSLSASVGDRVTITCRASQSILSYVNWYQQKPGKAPKLLIYATTSRHSGVPSRFSGSGSGTDFTLTISSLQPEDFATYYCQQSYESPLTFGGGTKVEIK

SEQ ID NO: 544 - protein, 107 aa, Artificial Sequence
  synthetic polypeptide
DIQMTQSPSSLSASVGDRVTITCRASQSILSYLNWYQQKPGKAPKLLIYATTSRASGVPSRFSGSGSGTDFTLTISSLQPEDFATYYCQQSYDNPLTFGGGTKVEIK

SEQ ID NO: 545 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYELPLTFGGGTKVEIK

SEQ ID NO: 546 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSNELPLTFGGGTKVEIK

SEQ ID NO: 547 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYDTPLTFGGGTKVEIK

SEQ ID NO: 548 - protein, 107 aa, Artificial Sequence
  synthetic polypeptide
DIQMTQSPSSLSASVGDRVTITCRASQSIVSYVNWYQQKPGKAPKLVIYAATSRHSGVPSRFSGSGSGTDFTLTISSLQPEDFATYYCQQSYDLPLTFGGGTKVEIK

SEQ ID NO: 549 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSDDSPLTFGGGTKVEIK

SEQ ID NO: 550 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSYNLPLTFGGGTKVEIK

SEQ ID NO: 551 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYENPLTFGGGTKVEIK

SEQ ID NO: 552 - protein, 107 aa, Artificial Sequence; identical to SEQ ID NO: 67
  synthetic polypeptide

SEQ ID NO: 553 - protein, 107 aa, Artificial Sequence; identical to SEQ ID NO: 95
  synthetic polypeptide

SEQ ID NO: 554 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYENPLTFGGGTKVEIK

SEQ ID NO: 555 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSDSNPLTFGGGTKVEIK

SEQ ID NO: 556 - protein, 107 aa, Artificial Sequence
  synthetic polypeptide
DIQMTQSPSSLSASVGDRVTITCRASQSIITYVNWYQQKPGKAPKLLIYATTSRASGVPSRFSGSGSGTDFTLTISSLQPEDFATYYCQQSYDLPLTFGGGTKVEIK

SEQ ID NO: 557 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYENPLTFGGGTKVEIK

SEQ ID NO: 558 - protein, 107 aa, Artificial Sequence [sequence omitted]

SEQ ID NO: 559 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYSSPLTFGGGTKVEIK

SEQ ID NO: 560 - protein, 107 aa, Artificial Sequence
  synthetic polypeptide
DIQMTQSPSSLSASVGDRVTITCRASQSILSYVNWYQQKPGKAPKLVIYAATSLHSGVPSRFSGSGSGTDFTLTISSLQPEDFATYYCQQSYETPLTFGGGTKVEIK

SEQ ID NO: 561 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSDNTPLTFGGGTKVEIK

SEQ ID NO: 562 - protein, 107 aa, Artificial Sequence
  synthetic polypeptide
DIQMTQSPSSLSASVGDRVTITCRASQSILSYVNWYQQKPGKAPKLVIYAVTSRHSGVPSRFSGSGSGTDFTLTISSLQPEDFATYYCQQSYSNPLTFGGGTKVEIK

SEQ ID NO: 563 - protein, 107 aa, Artificial Sequence
  synthetic polypeptide
DIQMTQSPSSLSASVGDRVTITCRASQSIVSYVNWYQQKPGKAPKLVIYAATSLASGVPSRFSGSGSGTDFTLTISSLQPEDFATYYCQQSYDLPLTFGGGTKVEIK

SEQ ID NO: 564 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYDLPLTFGGGTKVEIK

SEQ ID NO: 565 - protein, 107 aa, Artificial Sequence; identical to SEQ ID NO: 563
  synthetic polypeptide

SEQ ID NO: 566 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYESPLTFGGGTKVEIK

SEQ ID NO: 567 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYDSPLTFGGGTKVEIK

SEQ ID NO: 568 - protein, 107 aa, Artificial Sequence
  synthetic polypeptide
DIQMTQSPSSLSASVGDRVTITCRASQSIVSYLNWYQQKPGKAPKLVIYAATSRHSGVPSRFSGSGSGTDFTLTISSLQPEDFATYYCQQSYDLPLTFGGGTKVEIK

SEQ ID NO: 569 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYDTPLTFGGGTKVEIK

SEQ ID NO: 570 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYENPLTFGGGTKVEIK

SEQ ID NO: 571 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYETPLTFGGGTKVEIK

SEQ ID NO: 572 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSYSSPLTFGGGTKVEIK

SEQ ID NO: 573 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYENPLTFGGGTKVEIK

SEQ ID NO: 574 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSDSLPLTFGGGTKVEIK

SEQ ID NO: 575 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSDNLPLTFGGGTKVEIK

SEQ ID NO: 576 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYNNPLTFGGGTKVEIK

SEQ ID NO: 577 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYELPLTFGGGTKVEIK

SEQ ID NO: 578 - protein, 107 aa, Artificial Sequence
  synthetic polypeptide
DIQMTQSPSSLSASVGDRVTITCRASQSILTYVNWYQQKPGKAPKLLIYAASSLQSGVPSRFSGSGSGTDFTLTISSLQPEDFATYYCQQSYDTPLTFGGGTKVEIK

SEQ ID NO: 579 - protein, 107 aa, Artificial Sequence
  synthetic polypeptide
DIQMTQSPSSLSASVGDRVTITCRASQSILTYLNWYQQKPGKAPKLLIYAASSLQSGVPSRFSGSGSGTDFTLTISSLQPEDFATYYCQQSYDSPLTFGGGTKVEIK

SEQ ID NO: 580 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSDSNPLTFGGGTKVEIK

SEQ ID NO: 581 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYSLPLTFGGGTKVEIK

SEQ ID NO: 582 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYESPLTFGGGTKVEIK

SEQ ID NO: 583 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYDLPLTFGGGTKVEIK

SEQ ID NO: 584 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYDNPLTFGGGTKVEIK

SEQ ID NO: 585 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYNLPLTFGGGTKVEIK

SEQ ID NO: 586 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYDTPLTFGGGTKVEIK

SEQ ID NO: 587 - protein, 107 aa, Artificial Sequence; identical to SEQ ID NO: 555
  synthetic polypeptide

SEQ ID NO: 588 - protein, 107 aa, Artificial Sequence; identical to SEQ ID NO: 85
  synthetic polypeptide

SEQ ID NO: 589 - protein, 107 aa, Artificial Sequence
  synthetic polypeptide
DIQMTQSPSSLSASVGDRVTITCRASQSIISYLNWYQQKPGKAPKLLIYAATSLASGVPSRFSGSGSGTDFTLTISSLQPEDFATYYCQQSYESPLTFGGGTKVEIK

SEQ ID NO: 590 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYDTPLTFGGGTKVEIK

SEQ ID NO: 591 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYESPLTFGGGTKVEIK

SEQ ID NO: 592 - protein, 107 aa, Artificial Sequence; identical to SEQ ID NO: 100
  synthetic polypeptide

SEQ ID NO: 593 - protein, 107 aa, Artificial Sequence
  synthetic polypeptide
DIQMTQSPSSLSASVGDRVTITCRASQSILTYLNWYQQKPGKAPKLLIYAASSLQSGVPSRFSGSGSGTDFTLTISSLQPEDFATYYCQQSYELPLTFGGGTKVEIK

SEQ ID NO: 594 - protein, 107 aa, Artificial Sequence
  synthetic polypeptide
DIQMTQSPSSLSASVGDRVTITCRASQSISSYVNWYQQKPGKAPKLLIYAVTSRASGVPSRFSGSGSGTDFTLTISSLQPEDFATYYCQQSYSTPLTFGGGTKVEIK

SEQ ID NO: 595 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYSNPLTFGGGTKVEIK

SEQ ID NO: 596 - protein, 107 aa, Artificial Sequence
  synthetic polypeptide
DIQMTQSPSSLSASVGDRVTITCRASQSILTYLNWYQQKPGKAPKLVIYYANNRPSGVPSRFSGSGSGTDFTLTISSLQPEDFATYYCQQSYSNPLTFGGGTKVEIK

SEQ ID NO: 597 - protein, 107 aa, Artificial Sequence
  synthetic polypeptide
DIQMTQSPSSLSASVGDRVTITCRASQSILTYVNWYQQKPGKAPKLLIYAVTSRASGVPSRFSGSGSGTDFTLTISSLQPEDFATYYCQQSYDTPLTFGGGTKVEIK

SEQ ID NO: 598 - protein, 107 aa, Artificial Sequence
  synthetic polypeptide
DIQMTQSPSSLSASVGDRVTITCRASQSIITYLNWYQQKPGKAPKLVIYAATSRASGVPSRFSGSGSGTDFTLTISSLQPEDFATYYCQQSYESPLTFGGGTKVEIK

SEQ ID NO: 599 - protein, 6 aa, Artificial Sequence
  synthetic polypeptide
SSYGMH

SEQ ID NO: 600 - protein, 6 aa, Artificial Sequence
  synthetic polypeptide
DSYGMN

SEQ ID NO: 601 - protein, 6 aa, Artificial Sequence
  synthetic polypeptide
SDYGMH

SEQ ID NO: 602 - protein, 6 aa, Artificial Sequence
  synthetic polypeptide
DDYSMH

SEQ ID NO: 603 - protein, 6 aa, Artificial Sequence
  synthetic polypeptide
DSYSMH

SEQ ID NO: 604 - protein, 6 aa, Artificial Sequence
  synthetic polypeptide
DSYGMN

SEQ ID NO: 605 - protein, 6 aa, Artificial Sequence
  synthetic polypeptide
DDYGMH

SEQ ID NO: 606 - protein, 6 aa, Artificial Sequence
  synthetic polypeptide
DSYGMH

SEQ ID NO: 607 - protein, 6 aa, Artificial Sequence
  synthetic polypeptide
SSYGMH

SEQ ID NO: 608 - protein, 6 aa, Artificial Sequence
  synthetic polypeptide
SDYGMH

SEQ ID NO: 609 - protein, 6 aa, Artificial Sequence
  synthetic polypeptide
DDYGMH

SEQ ID NO: 610 - protein, 6 aa, Artificial Sequence
  synthetic polypeptide
DSYGMH

SEQ ID NO: 611 - protein, 6 aa, Artificial Sequence
  synthetic polypeptide
DSYGMH

SEQ ID NO: 612 - protein, 6 aa, Artificial Sequence
  synthetic polypeptide
DDYSMH

SEQ ID NO: 613 - protein, 6 aa, Artificial Sequence
  synthetic polypeptide
DSYSMH

SEQ ID NO: 614 - protein, 6 aa, Artificial Sequence
  synthetic polypeptide
SSYGMH

SEQ ID NO: 615 - protein, 6 aa, Artificial Sequence
  synthetic polypeptide
SDYGMN

SEQ ID NO: 616 - protein, 6 aa, Artificial Sequence
  synthetic polypeptide
SSYGMH

SEQ ID NO: 617 - protein, 6 aa, Artificial Sequence
  synthetic polypeptide
SSYGMH

SEQ ID NO: 618 - protein, 6 aa, Artificial Sequence
  synthetic polypeptide
DSYGMN

SEQ ID NO: 619 - protein, 6 aa, Artificial Sequence
  synthetic polypeptide
DSYSMH

SEQ ID NO: 620 - protein, 6 aa, Artificial Sequence
  synthetic polypeptide
SSYGMH

SEQ ID NO: 621 - protein, 6 aa, Artificial Sequence
  synthetic polypeptide
DSYGMN

SEQ ID NO: 622 - protein, 6 aa, Artificial Sequence
  synthetic polypeptide
DSYGMH

SEQ ID NO: 623 - protein, 6 aa, Artificial Sequence
  synthetic polypeptide
DSYGMH

SEQ ID NO: 624 - protein, 6 aa, Artificial Sequence
  synthetic polypeptide
DSYGMH

SEQ ID NO: 625 - protein, 6 aa, Artificial Sequence
  synthetic polypeptide
SSYGMH

SEQ ID NO: 626 - protein, 6 aa, Artificial Sequence
  synthetic polypeptide
DSYGMH

SEQ ID NO: 627 - protein, 6 aa, Artificial Sequence
  synthetic polypeptide
SDYSMH

SEQ ID NO: 628 - protein, 6 aa, Artificial Sequence
  synthetic polypeptide
SSYGMN

SEQ ID NO: 629 - protein, 6 aa, Artificial Sequence
  synthetic polypeptide
DSYGMH

SEQ ID NO: 630 - protein, 6 aa, Artificial Sequence
  synthetic polypeptide
DSYSMH

SEQ ID NO: 631 - protein, 6 aa, Artificial Sequence
  synthetic polypeptide
DSYGMH

SEQ ID NO: 632 - protein, 6 aa, Artificial Sequence
  synthetic polypeptide
DSYGMH

SEQ ID NO: 633 - protein, 6 aa, Artificial Sequence
  synthetic polypeptide
DDYSMH

SEQ ID NO: 634 - protein, 6 aa, Artificial Sequence
  synthetic polypeptide
DSYGMH

SEQ ID NO: 635 - protein, 6 aa, Artificial Sequence
  synthetic polypeptide
SSYSMH

SEQ ID NO: 636 - protein, 6 aa, Artificial Sequence
  synthetic polypeptide
DSYGMH

SEQ ID NO: 637 - protein, 6 aa, Artificial Sequence
  synthetic polypeptide
DSYGMH

SEQ ID NO: 638 - protein, 6 aa, Artificial Sequence
  synthetic polypeptide
SSYSMH

SEQ ID NO: 639 - protein, 6 aa, Artificial Sequence
  synthetic polypeptide
SSYGMH

SEQ ID NO: 640 - protein, 6 aa, Artificial Sequence
  synthetic polypeptide
SDYGMH

SEQ ID NO: 641 - protein, 6 aa, Artificial Sequence
  synthetic polypeptide
SSYGMH

SEQ ID NO: 642 - protein, 6 aa, Artificial Sequence
  synthetic polypeptide
SSYGMH

SEQ ID NO: 643 - protein, 6 aa, Artificial Sequence
  synthetic polypeptide
SSYGMH

SEQ ID NO: 644 - protein, 6 aa, Artificial Sequence
  synthetic polypeptide
DSYGMH

SEQ ID NO: 645 - protein, 6 aa, Artificial Sequence
  synthetic polypeptide
SSYGMH

SEQ ID NO: 646 - protein, 6 aa, Artificial Sequence
  synthetic polypeptide
SSYGMH

SEQ ID NO: 647 - protein, 6 aa, Artificial Sequence
  synthetic polypeptide
DSYGMN

SEQ ID NO: 648 - protein, 6 aa, Artificial Sequence
  synthetic polypeptide
SSYSMH

SEQ ID NO: 649 - protein, 6 aa, Artificial Sequence
  synthetic polypeptide
DSYGMH

SEQ ID NO: 650 - protein, 6 aa, Artificial Sequence
  synthetic polypeptide
DDYGMH

SEQ ID NO: 651 - protein, 6 aa, Artificial Sequence
  synthetic polypeptide
SSYGMH

SEQ ID NO: 652 - protein, 6 aa, Artificial Sequence
  synthetic polypeptide
SDYGMH

SEQ ID NO: 653 - protein, 6 aa, Artificial Sequence
  synthetic polypeptide
SSYGMN

SEQ ID NO: 654 - protein, 6 aa, Artificial Sequence
  synthetic polypeptide
DSYGMH

SEQ ID NO: 655 - protein, 6 aa, Artificial Sequence
  synthetic polypeptide
SSYGMH

SEQ ID NO: 656 - protein, 6 aa, Artificial Sequence
  synthetic polypeptide
SSYGMH

SEQ ID NO: 657 - protein, 6 aa, Artificial Sequence
  synthetic polypeptide
SSYGMH

SEQ ID NO: 658 - protein, 6 aa, Artificial Sequence
  synthetic polypeptide
DSYGMH

SEQ ID NO: 659 - protein, 6 aa, Artificial Sequence
  synthetic polypeptide
DSYGMH

SEQ ID NO: 660 - protein, 6 aa, Artificial Sequence
  synthetic polypeptide
SSYGMH

SEQ ID NO: 661 - protein, 6 aa, Artificial Sequence
  synthetic polypeptide
SSYGMH

SEQ ID NO: 662 - protein, 6 aa, Artificial Sequence
  synthetic polypeptide
DSYSMH

SEQ ID NO: 663 - protein, 6 aa, Artificial Sequence
  synthetic polypeptide
  misc_feature (1)..(1): Xaa can be any naturally occurring amino acid
XSYGMN

SEQ ID NO: 664 - protein, 6 aa, Artificial Sequence
  synthetic polypeptide
SSYSMN

SEQ ID NO: 665 - protein, 6 aa, Artificial Sequence
  synthetic polypeptide
SSYGMH

SEQ ID NO: 666 - protein, 6 aa, Artificial Sequence
  synthetic polypeptide
SSYGMH

SEQ ID NO: 667 - protein, 6 aa, Artificial Sequence
  synthetic polypeptide
DSYGMN

SEQ ID NO: 668 - protein, 6 aa, Artificial Sequence
  synthetic polypeptide
DSYSMH

SEQ ID NO: 669 - protein, 6 aa, Artificial Sequence
  synthetic polypeptide
SDYGMH

SEQ ID NO: 670 - protein, 13 aa, Artificial Sequence
  synthetic polypeptide
WVSSINYNGGYTS

SEQ ID NO: 671 - protein, 13 aa, Artificial Sequence
  synthetic polypeptide
WVSNINYNSGYKG

SEQ ID NO: 672 - protein, 13 aa, Artificial Sequence
  synthetic polypeptide
WVSGINYNGGYTS

SEQ ID NO: 673 - protein, 13 aa, Artificial Sequence
  synthetic polypeptide
WVASINYNGGYKS

SEQ ID NO: 674 - protein, 13 aa, Artificial Sequence
  synthetic polypeptide
WVSSINYNGGYTS

SEQ ID NO: 675 - protein, 13 aa, Artificial Sequence
  synthetic polypeptide
WVSGINYNGGYTG

SEQ ID NO: 676 - protein, 13 aa, Artificial Sequence
  synthetic polypeptide
WVSGINYNGGYTS

SEQ ID NO: 677 - protein, 13 aa, Artificial Sequence
  synthetic polypeptide
WVAGINYNGGYTS

SEQ ID NO: 678 - protein, 13 aa, Artificial Sequence
  synthetic polypeptide
WVASINYNGGYTS

SEQ ID NO: 679 - protein, 13 aa, Artificial Sequence
  synthetic polypeptide
WVSSINYNSGYKS

SEQ ID NO: 680 - protein, 13 aa, Artificial Sequence
  synthetic polypeptide
WVSSINYNGGYTG

SEQ ID NO: 681 - protein, 13 aa, Artificial Sequence
  synthetic polypeptide
WVAGINYNGGYTS

SEQ ID NO: 682 - protein, 13 aa, Artificial Sequence
  synthetic polypeptide
WVSSINYNGGYTS

SEQ ID NO: 683 - protein, 13 aa, Artificial Sequence
  synthetic polypeptide
WVANINYNGGYTS

SEQ ID NO: 684 - protein, 13 aa, Artificial Sequence
  synthetic polypeptide
WVASINYNGGYKS

SEQ ID NO: 685 - protein, 13 aa, Artificial Sequence
  synthetic polypeptide
WVSGINYNGGYTS

SEQ ID NO: 686 - protein, 13 aa, Artificial Sequence
  synthetic polypeptide
WVASINYNGGYTS

SEQ ID NO: 687 - protein, 13 aa, Artificial Sequence
  synthetic polypeptide
WVSSINYNGGYTG

SEQ ID NO: 688 - protein, 13 aa, Artificial Sequence
  synthetic polypeptide
WVSSINYNSGYTS

SEQ ID NO: 689 - protein, 13 aa, Artificial Sequence
  synthetic polypeptide
WVSGINYNSGYTS

SEQ ID NO: 690 - protein, 13 aa, Artificial Sequence
  synthetic polypeptide
WVANINYNGGYTS

SEQ ID NO: 691 - protein, 13 aa, Artificial Sequence
  synthetic polypeptide
WVASINYNGGYTS

SEQ ID NO: 692 - protein, 13 aa, Artificial Sequence
  synthetic polypeptide
WVSSINYNGGYTS

SEQ ID NO: 693 - protein, 13 aa, Artificial Sequence
  synthetic polypeptide
WVSSINYNGGYTS

SEQ ID NO: 694 - protein, 13 aa, Artificial Sequence
  synthetic polypeptide
WVSGINYNSGYTS

SEQ ID NO: 695 - protein, 13 aa, Artificial Sequence
  synthetic polypeptide
WVSNINYNGGYTS

SEQ ID NO: 696 - protein, 13 aa, Artificial Sequence
  synthetic polypeptide
WVAGINYNSGYTS

SEQ ID NO: 697 - protein, 13 aa, Artificial Sequence
  synthetic polypeptide
WVASINYNGGYTS

SEQ ID NO: 698 - protein, 13 aa, Artificial Sequence
  synthetic polypeptide
WVASINYNGGYTS

SEQ ID NO: 699 - protein, 13 aa, Artificial Sequence
  synthetic polypeptide
WVSNINYNGGYTG

SEQ ID NO: 700 - protein, 13 aa, Artificial Sequence
  synthetic polypeptide
WVASINYNGGYTG

SEQ ID NO: 701 - protein, 13 aa, Artificial Sequence
  synthetic polypeptide
WVSSINYNGGYKS

SEQ ID NO: 702 - protein, 13 aa, Artificial Sequence
  synthetic polypeptide
WVANINYNSGYTG

SEQ ID NO: 703 - protein, 13 aa, Artificial Sequence
  synthetic polypeptide
WVSGINYNSGYKS

SEQ ID NO: 704 - protein, 13 aa, Artificial Sequence
  synthetic polypeptide
WVASINYNGGYTG

SEQ ID NO: 705 - protein, 13 aa, Artificial Sequence
  synthetic polypeptide
WVASINYNGGYKS

SEQ ID NO: 706 - protein, 13 aa, Artificial Sequence
  synthetic polypeptide
WVASINYNSGYTG

SEQ ID NO: 707 - protein, 13 aa, Artificial Sequence
  synthetic polypeptide
WVANINYNGGYKS

SEQ ID NO: 708 - protein, 13 aa, Artificial Sequence
  synthetic polypeptide
WVSSINYNGGYTS

SEQ ID NO: 709 - protein, 13 aa, Artificial Sequence
  synthetic polypeptide
WVSSINYNGGYKS

SEQ ID NO: 710 - protein, 13 aa, Artificial Sequence
  synthetic polypeptide
WVSSINYNGGYTG

SEQ ID NO: 711 - protein, 13 aa, Artificial Sequence
  synthetic polypeptide
WVAGINYNGGYTG

SEQ ID NO: 712 - protein, 13 aa, Artificial Sequence
  synthetic polypeptide
WVAGINYNGGYTS

SEQ ID NO: 713 - protein, 13 aa, Artificial Sequence
  synthetic polypeptide
WVAGINYNGGYTS

SEQ ID NO: 714 - protein, 13 aa, Artificial Sequence
  synthetic polypeptide
WVANINYNSGYKS

SEQ ID NO: 715 - protein, 13 aa, Artificial Sequence
  synthetic polypeptide
WVAGINYNGGYTS

SEQ ID NO: 716 - protein, 13 aa, Artificial Sequence
  synthetic polypeptide
WVSNINYNGGYTS

SEQ ID NO: 717 - protein, 13 aa, Artificial Sequence
  synthetic polypeptide
WVSNINYNGGYKS

SEQ ID NO: 718 - protein, 13 aa, Artificial Sequence
  synthetic polypeptide
WVSNINYNGGYTS

SEQ ID NO: 719 - protein, 13 aa, Artificial Sequence
  synthetic polypeptide
WVASINYNSGYTS

SEQ ID NO: 720 - protein, 13 aa, Artificial Sequence
  synthetic polypeptide
WVAGINYNSGYTG

SEQ ID NO: 721 - protein, 13 aa, Artificial Sequence
  synthetic polypeptide
WVSGINYNGGYTS

SEQ ID NO: 722 - protein, 13 aa, Artificial Sequence
  synthetic polypeptide
WVAGINYNGGYTS

SEQ ID NO: 723 - protein, 13 aa, Artificial Sequence
  synthetic polypeptide
WVAGINYNGGYTS

SEQ ID NO: 724 - protein, 13 aa, Artificial Sequence
  synthetic polypeptide
WVAGINYNGGYTS

SEQ ID NO: 725 - protein, 13 aa, Artificial Sequence
  synthetic polypeptide
WVSGINYNGGYKS

SEQ ID NO: 726 - protein, 13 aa, Artificial Sequence
  synthetic polypeptide
WVAGINYNGGYTS

SEQ ID NO: 727 - protein, 13 aa, Artificial Sequence
  synthetic polypeptide
WVASINYNSGYTG

SEQ ID NO: 728 - protein, 13 aa, Artificial Sequence
  synthetic polypeptide
WVSGINYNGGYTS

SEQ ID NO: 729 - protein, 13 aa, Artificial Sequence
  synthetic polypeptide
WVSSINYNGGYTS

SEQ ID NO: 730 - protein, 13 aa, Artificial Sequence
  synthetic polypeptide
WVAGINYNSGYTS

SEQ ID NO: 731 - protein, 13 aa, Artificial Sequence
  synthetic polypeptide
WVSSINYNGGYKS

SEQ ID NO: 732 - protein, 13 aa, Artificial Sequence
  synthetic polypeptide
WVASINYNGGYTS

SEQ ID NO: 733 - protein, 13 aa, Artificial Sequence
  synthetic polypeptide
WVSGINYNGGYTS

SEQ ID NO: 734 - protein, 13 aa, Artificial Sequence
  synthetic polypeptide
WVASINYNGGYKG

SEQ ID NO: 735 - protein, 13 aa, Artificial Sequence
  synthetic polypeptide
WVSNINYNGGYTS

SEQ ID NO: 736 - protein, 13 aa, Artificial Sequence
  synthetic polypeptide
WVSGINYNGGYTS

SEQ ID NO: 737 - protein, 13 aa, Artificial Sequence
  synthetic polypeptide
WVAGINYNSGYTG

SEQ ID NO: 738 - protein, 13 aa, Artificial Sequence
  synthetic polypeptide
WVANINYNSGYKS

SEQ ID NO: 739 - protein, 13 aa, Artificial Sequence
  synthetic polypeptide
WVSSINYNGGYKS

SEQ ID NO: 740 - protein, 13 aa, Artificial Sequence
  synthetic polypeptide
WVASINYNGGYTS

SEQ ID NO: 741 - protein, 6 aa, Artificial Sequence
  synthetic polypeptide
  MISC_FEATURE (1)..(6): Xaa at positions 1 to 6 may be any amino acid.
XXXXXX

SEQ ID NO: 742 - protein, 6 aa, Artificial Sequence
  synthetic polypeptide
SEQIDN

SEQ ID NO: 743 - protein, 6 aa, Artificial Sequence
  synthetic polypeptide
SEQIDN

SEQ ID NO: 744 - protein, 6 aa, Artificial Sequence
  synthetic polypeptide
SEQIDN

SEQ ID NO: 745 - protein, 6 aa, Artificial Sequence
  synthetic polypeptide
SEQIDN

SEQ ID NO: 746 - protein, 6 aa, Artificial Sequence
  synthetic polypeptide
SEQIDN

SEQ ID NO: 747 - protein, 6 aa, Artificial Sequence
  synthetic polypeptide
SEQIDN

SEQ ID NO: 748 - protein, 6 aa, Artificial Sequence
  synthetic polypeptide
SEQIDN

SEQ ID NO: 749 - protein, 6 aa, Artificial Sequence
  synthetic polypeptide
SEQIDN

SEQ ID NO: 750 - protein, 6 aa, Artificial Sequence
  synthetic polypeptide
SEQIDN

SEQ ID NO: 751 - protein, 6 aa, Artificial Sequence
  synthetic polypeptide
SEQIDN

SEQ ID NO: 752 - protein, 6 aa, Artificial Sequence
  synthetic polypeptide
SEQIDN

SEQ ID NO: 753 - protein, 6 aa, Artificial Sequence
  synthetic polypeptide
SEQIDN

SEQ ID NO: 754 - protein, 6 aa, Artificial Sequence
  synthetic polypeptide
SEQIDN

SEQ ID NO: 755 - protein, 6 aa, Artificial Sequence
  synthetic polypeptide
SEQIDN

SEQ ID NO: 756 - protein, 6 aa, Artificial Sequence
  synthetic polypeptide
SEQIDN

SEQ ID NO: 757 - protein, 6 aa, Artificial Sequence
  synthetic polypeptide
SEQIDN

SEQ ID NO: 758 - protein, 6 aa, Artificial Sequence
  synthetic polypeptide
SEQIDN

SEQ ID NO: 759 - protein, 6 aa, Artificial Sequence
  synthetic polypeptide
SEQIDN

SEQ ID NO: 760 - protein, 6 aa, Artificial Sequence
  synthetic polypeptide
SEQIDN

SEQ ID NO: 761 - protein, 6 aa, Artificial Sequence
  synthetic polypeptide
SEQIDN

SEQ ID NO: 762 - protein, 6 aa, Artificial Sequence
  synthetic polypeptide
SEQIDN

SEQ ID NO: 763 - protein, 6 aa, Artificial Sequence
  synthetic polypeptide
SEQIDN

SEQ ID NO: 764 - protein, 6 aa, Artificial Sequence
  synthetic polypeptide
SEQIDN

SEQ ID NO: 765 - protein, 6 aa, Artificial Sequence
  synthetic polypeptide
SEQIDN

SEQ ID NO: 766 - protein, 6 aa, Artificial Sequence
  synthetic polypeptide
SEQIDN

SEQ ID NO: 767 - protein, 6 aa, Artificial Sequence
  synthetic polypeptide
SEQIDN

SEQ ID NO: 768 - protein, 6 aa, Artificial Sequence
  synthetic polypeptide
SEQIDN

SEQ ID NO: 769 - protein, 6 aa, Artificial Sequence
  synthetic polypeptide
SEQIDN

SEQ ID NO: 770 - protein, 6 aa, Artificial Sequence
  synthetic polypeptide
SEQIDN

SEQ ID NO: 771 - protein, 6 aa, Artificial Sequence
  synthetic polypeptide
SEQIDN

SEQ ID NO: 772 - protein, 6 aa, Artificial Sequence
  synthetic polypeptide
SEQIDN

SEQ ID NO: 773 - protein, 6 aa, Artificial Sequence
  synthetic polypeptide
SEQIDN

SEQ ID NO: 774 - protein, 6 aa, Artificial Sequence
  synthetic polypeptide
SEQIDN

SEQ ID NO: 775 - protein, 6 aa, Artificial Sequence
  synthetic polypeptide
SEQIDN

SEQ ID NO: 776 - protein, 6 aa, Artificial Sequence
  synthetic polypeptide
SEQIDN

SEQ ID NO: 777 - protein, 6 aa, Artificial Sequence
  synthetic polypeptide
SEQIDN

SEQ ID NO: 778 - protein, 6 aa, Artificial Sequence
  synthetic polypeptide
SEQIDN

SEQ ID NO: 779 - protein, 6 aa, Artificial Sequence
  synthetic polypeptide
SEQIDN

SEQ ID NO: 780 - protein, 6 aa, Artificial Sequence
  synthetic polypeptide
SEQIDN

SEQ ID NO: 781 - protein, 6 aa, Artificial Sequence
  synthetic polypeptide
SEQIDN

SEQ ID NO: 782 - protein, 6 aa, Artificial Sequence
  synthetic polypeptide
SEQIDN

SEQ ID NO: 783 - protein, 6 aa, Artificial Sequence
  synthetic polypeptide
SEQIDN

SEQ ID NO: 784 - protein, 6 aa, Artificial Sequence
  synthetic polypeptide
SEQIDN

SEQ ID NO: 785 - protein, 6 aa, Artificial Sequence
  synthetic polypeptide
SEQIDN

SEQ ID NO: 786 - protein, 6 aa, Artificial Sequence
  synthetic polypeptide
SEQIDN

SEQ ID NO: 787 - protein, 6 aa, Artificial Sequence
  synthetic polypeptide
SEQIDN

SEQ ID NO: 788 - protein, 6 aa, Artificial Sequence
  synthetic polypeptide
SEQIDN

SEQ ID NO: 789 - protein, 6 aa, Artificial Sequence
  synthetic polypeptide
SEQIDN

SEQ ID NO: 790 - protein, 6 aa, Artificial Sequence
  synthetic polypeptide
SEQIDN

SEQ ID NO: 791 - protein, 6 aa, Artificial Sequence
  synthetic polypeptide
SEQIDN

SEQ ID NO: 792 - protein, 6 aa, Artificial Sequence
  synthetic polypeptide
SEQIDN

SEQ ID NO: 793 - protein, 6 aa, Artificial Sequence
  synthetic polypeptide
SEQIDN

SEQ ID NO: 794 - protein, 6 aa, Artificial Sequence
  synthetic polypeptide
SEQIDN

SEQ ID NO: 795 - protein, 6 aa, Artificial Sequence
  synthetic polypeptide
SEQIDN

SEQ ID NO: 796 - protein, 6 aa, Artificial Sequence
  synthetic polypeptide
SEQIDN

SEQ ID NO: 797 - protein, 6 aa, Artificial Sequence
  synthetic polypeptide
SEQIDN

SEQ ID NO: 798 - protein, 6 aa, Artificial Sequence
  synthetic polypeptide
SEQIDN

SEQ ID NO: 799 - protein, 6 aa, Artificial Sequence
  synthetic polypeptide
SEQIDN

SEQ ID NO: 800 - protein, 6 aa, Artificial Sequence
  synthetic polypeptide
SEQIDN

SEQ ID NO: 801 - protein, 6 aa, Artificial Sequence
  synthetic polypeptide
SEQIDN

SEQ ID NO: 802 - protein, 6 aa, Artificial Sequence
  synthetic polypeptide
SEQIDN

SEQ ID NO: 803 - protein, 6 aa, Artificial Sequence
  synthetic polypeptide
SEQIDN

SEQ ID NO: 804 - protein, 6 aa, Artificial Sequence
  synthetic polypeptide
SEQIDN

SEQ ID NO: 805 - protein, 6 aa, Artificial Sequence
  synthetic polypeptide
SEQIDN

SEQ ID NO: 806 - protein, 6 aa, Artificial Sequence
  synthetic polypeptide
SEQIDN

SEQ ID NO: 807 - protein, 6 aa, Artificial Sequence
  synthetic polypeptide
SEQIDN

SEQ ID NO: 808 - protein, 6 aa, Artificial Sequence
  synthetic polypeptide
SEQIDN

SEQ ID NO: 809 - protein, 6 aa, Artificial Sequence
  synthetic polypeptide
SEQIDN

SEQ ID NO: 810 - protein, 6 aa, Artificial Sequence
  synthetic polypeptide
SEQIDN

SEQ ID NO: 811 - protein, 6 aa, Artificial Sequence
  synthetic polypeptide
SEQIDN

SEQ ID NO: 812 - protein, 6 aa, Artificial Sequence
  synthetic polypeptide
SEQIDN

SEQ ID NO: 813 - protein, 7 aa, Artificial Sequence
  synthetic polypeptide
SSYLNWY

SEQ ID NO: 814 - protein, 7 aa, Artificial Sequence
  synthetic polypeptide
VTYLNWY

SEQ ID NO: 815 - protein, 7 aa, Artificial Sequence
  synthetic polypeptide
STYVNWY

SEQ ID NO: 816 - protein, 7 aa, Artificial Sequence
  synthetic polypeptide
VSYLNWY

SEQ ID NO: 817 - protein, 7 aa, Artificial Sequence
  synthetic polypeptide
ITYVNWY

SEQ ID NO: 818 - protein, 7 aa, Artificial Sequence
  synthetic polypeptide
LTYLNWY

SEQ ID NO: 819 - protein, 7 aa, Artificial Sequence
  synthetic polypeptide
VTYVNWY

SEQ ID NO: 820 - protein, 7 aa, Artificial Sequence
  synthetic polypeptide
LSYLNWY

SEQ ID NO: 821 - protein, 7 aa, Artificial Sequence
  synthetic polypeptide
SSYLNWY

SEQ ID NO: 822 - protein, 7 aa, Artificial Sequence
  synthetic polypeptide
LTYLNWY

SEQ ID NO: 823 - protein, 7 aa, Artificial Sequence
  synthetic polypeptide
ISYLNWY

SEQ ID NO: 824 - protein, 7 aa, Artificial Sequence
  synthetic polypeptide
LTYLNWY

SEQ ID NO: 825 - protein, 7 aa, Artificial Sequence
  synthetic polypeptide
LTYLNWY

SEQ ID NO: 826 - protein, 7 aa, Artificial Sequence
  synthetic polypeptide
LTYLNWY

SEQ ID NO: 827 - protein, 7 aa, Artificial Sequence
  synthetic polypeptide
LTYLNWY

SEQ ID NO: 828 - protein, 7 aa, Artificial Sequence
  synthetic polypeptide
LSYVNWY

SEQ ID NO: 829 - protein, 7 aa, Artificial Sequence
  synthetic polypeptide
LSYLNWY

SEQ ID NO: 830 - protein, 7 aa, Artificial Sequence
  synthetic polypeptide
LSYVNWY

SEQ ID NO: 831 - protein, 7 aa, Artificial Sequence
  synthetic polypeptide
LSYVNWY

SEQ ID NO: 832 - protein, 7 aa, Artificial Sequence
  synthetic polypeptide
LTYLNWY

SEQ ID NO: 833 - protein, 7 aa, Artificial Sequence
  synthetic polypeptide
VSYVNWY

SEQ ID NO: 834 - protein, 7 aa, Artificial Sequence
  synthetic polypeptide
LTYLNWY

SEQ ID NO: 835 - protein, 7 aa, Artificial Sequence
  synthetic polypeptide
LTYVNWY

SEQ ID NO: 836 - protein, 7 aa, Artificial Sequence
  synthetic polypeptide
VSYLNWY

SEQ ID NO: 837 - protein, 7 aa, Artificial Sequence
  synthetic polypeptide
VSYVNWY

SEQ ID NO: 838 - protein, 7 aa, Artificial Sequence
  synthetic polypeptide
LSYVNWY

SEQ ID NO: 839 - protein, 7 aa, Artificial Sequence
  synthetic polypeptide
VSYVNWY

SEQ ID NO: 840 - protein, 7 aa, Artificial Sequence
  synthetic polypeptide
LTYLNWY

SEQ ID NO: 841 - protein, 7 aa, Artificial Sequence
  synthetic polypeptide
ITYVNWY

SEQ ID NO: 842 - protein, 7 aa, Artificial Sequence
  synthetic polypeptide
LSYVNWY

SEQ ID NO: 843 - protein, 7 aa, Artificial Sequence
  synthetic polypeptide
SSYLNWY

SEQ ID NO: 844 - protein, 7 aa, Artificial Sequence
  synthetic polypeptide
LSYLNWY

SEQ ID NO: 845 - protein, 7 aa, Artificial Sequence
  synthetic polypeptide
LSYVNWY

SEQ ID NO: 846 - protein, 7 aa, Artificial Sequence
  synthetic polypeptide
LTYLNWY

SEQ ID NO: 847 - protein, 7 aa, Artificial Sequence
  synthetic polypeptide
LSYVNWY

SEQ ID NO: 848 - protein, 7 aa, Artificial Sequence
  synthetic polypeptide
VSYVNWY

SEQ ID NO: 849 - protein, 7 aa, Artificial Sequence
  synthetic polypeptide
LTYLNWY

SEQ ID NO: 850 - protein, 7 aa, Artificial Sequence
  synthetic polypeptide
VSYVNWY

SEQ ID NO: 851 - protein, 7 aa, Artificial Sequence
  synthetic polypeptide
LSYVNWY

SEQ ID NO: 852 - protein, 7 aa, Artificial Sequence
  synthetic polypeptide
LSYVNWY

SEQ ID NO: 853 - protein, 7 aa, Artificial Sequence
  synthetic polypeptide
VSYLNWY

SEQ ID NO: 854 - protein, 7 aa, Artificial Sequence
  synthetic polypeptide
LSYLNWY

SEQ ID NO: 855 - protein, 7 aa, Artificial Sequence
  synthetic polypeptide
LSYVNWY

SEQ ID NO: 856 - protein, 7 aa, Artificial Sequence
  synthetic polypeptide
VSYVNWY

SEQ ID NO: 857 - protein, 7 aa, Artificial Sequence
  synthetic polypeptide
LTYVNWY

SEQ ID NO: 858 - protein, 7 aa, Artificial Sequence
  synthetic polypeptide
LSYVNWY

SEQ ID NO: 859 - protein, 7 aa, Artificial Sequence
  synthetic polypeptide
LSYLNWY

SEQ ID NO: 860 - protein, 7 aa, Artificial Sequence
  synthetic polypeptide
LTYLNWY

SEQ ID NO: 861 - protein, 7 aa, Artificial Sequence
  synthetic polypeptide
LTYVNWY

SEQ ID NO: 862 - protein, 7 aa, Artificial Sequence
  synthetic polypeptide
LTYLNWY

SEQ ID NO: 863 - protein, 7 aa, Artificial Sequence
  synthetic polypeptide
LTYVNWY

SEQ ID NO: 864 - protein, 7 aa, Artificial Sequence
  synthetic polypeptide
LTYLNWY

SEQ ID NO: 865 - protein, 7 aa, Artificial Sequence
  synthetic polypeptide
LTYLNWY

SEQ ID NO: 866 - protein, 7 aa, Artificial Sequence
  synthetic polypeptide
VSYVNWY

SEQ ID NO: 867 - protein, 7 aa, Artificial Sequence
  synthetic polypeptide
LSYLNWY

SEQ ID NO: 868 - protein, 7 aa, Artificial Sequence
  synthetic polypeptide
LSYVNWY

SEQ ID NO: 869 - protein, 7 aa, Artificial Sequence
  synthetic polypeptide
LTYVNWY

SEQ ID NO: 870 - protein, 7 aa, Artificial Sequence
  synthetic polypeptide
LSYVNWY

SEQ ID NO: 871 - protein, 7 aa, Artificial Sequence
  synthetic polypeptide
LSYVNWY

SEQ ID NO: 872 - protein, 7 aa, Artificial Sequence
  synthetic polypeptide
LTYLNWY

SEQ ID NO: 873 - protein, 7 aa, Artificial Sequence
  synthetic polypeptide
LSYLNWY

SEQ ID NO: 874 - protein, 7 aa, Artificial Sequence
  synthetic polypeptide
ISYLNWY

SEQ ID NO: 875 - protein, 7 aa, Artificial Sequence
  synthetic polypeptide
LSYVNWY

SEQ ID NO: 876 - protein, 7 aa, Artificial Sequence
  synthetic polypeptide
LSYVNWY

SEQ ID NO: 877 - protein, 7 aa, Artificial Sequence
  synthetic polypeptide
LSYLNWY

SEQ ID NO: 878 - protein, 7 aa, Artificial Sequence
  synthetic polypeptide
LTYLNWY

SEQ ID NO: 879 - protein, 7 aa, Artificial Sequence
  synthetic polypeptide
SSYVNWY

SEQ ID NO: 880 - protein, 7 aa, Artificial Sequence
  synthetic polypeptide
LSYLNWY

SEQ ID NO: 881 - protein, 7 aa, Artificial Sequence
  synthetic polypeptide
LTYLNWY

SEQ ID NO: 882 - protein, 7 aa, Artificial Sequence
  synthetic polypeptide
LTYVNWY

SEQ ID NO: 883 - protein, 7 aa, Artificial Sequence
  synthetic polypeptide
ITYLNWY

SEQ ID NO: 884 - protein, 10 aa, Artificial Sequence
  synthetic polypeptide
LLIYAASSLQ

SEQ ID NO: 885 - protein, 10 aa, Artificial Sequence
  synthetic polypeptide
LLIYAATSRA

SEQ ID NO: 886 - protein, 10 aa, Artificial Sequence
  synthetic polypeptide
LLIYAVTSLH

SEQ ID NO: 887 - protein, 10 aa, Artificial Sequence
  synthetic polypeptide
LVIYAATSRA

SEQ ID NO: 888 - protein, 10 aa, Artificial Sequence
  synthetic polypeptide
LLIYAATSRA

SEQ ID NO: 889 - protein, 10 aa, Artificial Sequence
  synthetic polypeptide
LVIYAATSRA

SEQ ID NO: 890 - protein, 10 aa, Artificial Sequence
  synthetic polypeptide
LLIYAATSRA

SEQ ID NO: 891 - protein, 10 aa, Artificial Sequence
  synthetic polypeptide
LLIYAATSLA

SEQ ID NO: 892 - protein, 10 aa, Artificial Sequence
  synthetic polypeptide
LLIYAASSLQ

SEQ ID NO: 893 - protein, 10 aa, Artificial Sequence
  synthetic polypeptide
LVIYAATSRH

SEQ ID NO: 894 - protein, 10 aa, Artificial Sequence
  synthetic polypeptide
LVIYAATSRA

SEQ ID NO: 895 - protein, 10 aa, Artificial Sequence
  synthetic polypeptide
LVIYAATSRH

SEQ ID NO: 896 - protein, 10 aa, Artificial Sequence
  synthetic polypeptide
LLIYAATSRH

SEQ ID NO: 897 - protein, 10 aa, Artificial Sequence
  synthetic polypeptide
LVIYATTSRH

SEQ ID NO: 898 - protein, 10 aa, Artificial Sequence
  synthetic polypeptide
LVIYAATSLH

SEQ ID NO: 899 - protein, 10 aa, Artificial Sequence
  synthetic polypeptide
LLIYATTSRH

SEQ ID NO: 900 - protein, 10 aa, Artificial Sequence
  synthetic polypeptide
LLIYATTSRA

SEQ ID NO: 901 - protein, 10 aa, Artificial Sequence
  synthetic polypeptide
LLIYAATSRA

SEQ ID NO: 902 - protein, 10 aa, Artificial Sequence
  synthetic polypeptide
LVIYAATSRA

SEQ ID NO: 903 - protein, 10 aa, Artificial Sequence
  synthetic polypeptide
LLIYAATSRA

SEQ ID NO: 904 - protein, 10 aa, Artificial Sequence
  synthetic polypeptide
LVIYAATSRH

SEQ ID NO: 905 - protein, 10 aa, Artificial Sequence
  synthetic polypeptide
LLIYAATSRH

SEQ ID NO: 906 - protein, 10 aa, Artificial Sequence
  synthetic polypeptide
LLIYAATSRH

SEQ ID NO: 907 - protein, 10 aa, Artificial Sequence
  synthetic polypeptide
LVIYAATSRA

SEQ ID NO: 908 - protein, 10 aa, Artificial Sequence
  synthetic polypeptide
LLIYAATSRA

SEQ ID NO: 909 - protein, 10 aa, Artificial Sequence
  synthetic polypeptide
LLIYAATSRA

SEQ ID NO: 910 - protein, 10 aa, Artificial Sequence
  synthetic polypeptide
LVIYAATSRA

SEQ ID NO: 911 - protein, 10 aa, Artificial Sequence
  synthetic polypeptide
LLIYAATSRA

SEQ ID NO: 912 - protein, 10 aa, Artificial Sequence
  synthetic polypeptide
LLIYATTSRA

SEQ ID NO: 913 - protein, 10 aa, Artificial Sequence
  synthetic polypeptide
LVIYAATSRH

SEQ ID NO: 914 - protein, 10 aa, Artificial Sequence
  synthetic polypeptide
LLIYAASSLQ

SEQ ID NO: 915 - protein, 10 aa, Artificial Sequence
  synthetic polypeptide
LVIYAATSRA

SEQ ID NO: 916 - protein, 10 aa, Artificial Sequence
  synthetic polypeptide
LVIYAATSLH

SEQ ID NO: 917 - protein, 10 aa, Artificial Sequence
  synthetic polypeptide
LLIYAATSRA

SEQ ID NO: 918 - protein, 10 aa, Artificial Sequence
  synthetic polypeptide
LVIYAVTSRH

SEQ ID NO: 919 - protein, 10 aa, Artificial Sequence
  synthetic polypeptide
LVIYAATSLA

SEQ ID NO: 920 - protein, 10 aa, Artificial Sequence
  synthetic polypeptide
LLIYAATSRH

SEQ ID NO: 921 - protein, 10 aa, Artificial Sequence
  synthetic polypeptide
LVIYAATSLA

SEQ ID NO: 922 - protein, 10 aa, Artificial Sequence
  synthetic polypeptide
LLIYAATSRA

SEQ ID NO: 923 - protein, 10 aa, Artificial Sequence
  synthetic polypeptide
LLIYAATSRA

SEQ ID NO: 924 - protein, 10 aa, Artificial Sequence
  synthetic polypeptide
LVIYAATSRH

SEQ ID NO: 925 - protein, 10 aa, Artificial Sequence
  synthetic polypeptide
LVIYAATSRA

SEQ ID NO: 926 - protein, 10 aa, Artificial Sequence
  synthetic polypeptide
LLIYAATSLA

SEQ ID NO: 927 - protein, 10 aa, Artificial Sequence
  synthetic polypeptide
LVIYAATSRA

SEQ ID NO: 928 - protein, 10 aa, Artificial Sequence
  synthetic polypeptide
LLIYAATSRH

SEQ ID NO: 929 - protein, 10 aa, Artificial Sequence
  synthetic polypeptide
LLIYAATSRA

SEQ ID NO: 930 - protein, 10 aa, Artificial Sequence
  synthetic polypeptide
LLIYAASSLQ

SEQ ID NO: 931 - protein, 10 aa, Artificial Sequence
  synthetic polypeptide
LLIYAATSRA

SEQ ID NO: 932 - protein, 10 aa, Artificial Sequence
  synthetic polypeptide
LVIYAATSLA

SEQ ID NO: 933 - protein, 10 aa, Artificial Sequence
  synthetic polypeptide
LLIYAATSRA

SEQ ID NO: 934 - protein, 10 aa, Artificial Sequence
  synthetic polypeptide
LLIYAASSLQ

SEQ ID NO: 935 - protein, 10 aa, Artificial Sequence
  synthetic polypeptide
LLIYAASSLQ

SEQ ID NO: 936 - protein, 10 aa, Artificial Sequence
  synthetic polypeptide
LLIYAATSLA

SEQ ID NO: 937 - protein, 10 aa, Artificial Sequence
  synthetic polypeptide
LVIYAATSRA

SEQ ID NO: 938 - protein, 10 aa, Artificial Sequence
  synthetic polypeptide
LLIYAATSRA

SEQ ID NO: 939 - protein, 10 aa, Artificial Sequence
  synthetic polypeptide
LVIYAATSRA

SEQ ID NO: 940 - protein, 10 aa, Artificial Sequence
  synthetic polypeptide
LLIYAATSRA

SEQ ID NO: 941 - protein, 10 aa, Artificial Sequence
  synthetic polypeptide
LLIYAATSLA

SEQ ID NO: 942 - protein, 10 aa, Artificial Sequence
  synthetic polypeptide
LLIYAATSRA

SEQ ID NO: 943 - protein, 10 aa, Artificial Sequence
  synthetic polypeptide
LLIYAATSRA

SEQ ID NO: 944 - protein, 10 aa, Artificial Sequence
  synthetic polypeptide
LLIYAASSLQ

SEQ ID NO: 945 - protein, 10 aa, Artificial Sequence
  synthetic polypeptide
LLIYAATSLA

SEQ ID NO: 946 - protein, 10 aa, Artificial Sequence
  synthetic polypeptide
LLIYAATSLA

SEQ ID NO: 947 - protein, 10 aa, Artificial Sequence
  synthetic polypeptide
LVIYAATSRA

SEQ ID NO: 948 - protein, 10 aa, Artificial Sequence
  synthetic polypeptide
LLIYAATSRA

SEQ ID NO: 949 - protein, 10 aa, Artificial Sequence
  synthetic polypeptide
LLIYAASSLQ

SEQ ID NO: 950 - protein, 10 aa, Artificial Sequence
  synthetic polypeptide
LLIYAVTSRA

SEQ ID NO: 951 - protein, 10 aa, Artificial Sequence
  synthetic polypeptide
LVIYAATSRA

SEQ ID NO: 952 - protein, 10 aa, Artificial Sequence
  synthetic polypeptide
LVIYYANNRP

SEQ ID NO: 953 - protein, 10 aa, Artificial Sequence
  synthetic polypeptide
LLIYAVTSRA

SEQ ID NO: 954 - protein, 10 aa, Artificial Sequence
  synthetic polypeptide
LVIYAATSRA

SEQ ID NO: 955 - protein, 8 aa, Artificial Sequence
  synthetic polypeptide
QQSYSTPL

SEQ ID NO: 956 - protein, 8 aa, Artificial Sequence
  synthetic polypeptide
QQSYSSPL

SEQ ID NO: 957 - protein, 8 aa, Artificial Sequence
  synthetic polypeptide
QQSYDNPL

SEQ ID NO: 958 - protein, 8 aa, Artificial Sequence
  synthetic polypeptide
QQSYDSPL

SEQ ID NO: 959 - protein, 8 aa, Artificial Sequence
  synthetic polypeptide
QQSYDTPL

SEQ ID NO: 960 - protein, 8 aa, Artificial Sequence
  synthetic polypeptide
QQSYNTPL

SEQ ID NO: 961 - protein, 8 aa, Artificial Sequence
  synthetic polypeptide
QQSYELPL

SEQ ID NO: 962 - protein, 8 aa, Artificial Sequence
  synthetic polypeptide
QQSDSTPL

SEQ ID NO: 963 - protein, 8 aa, Artificial Sequence
  synthetic polypeptide
QQSYETPL

SEQ ID NO: 964 - protein, 8 aa, Artificial Sequence
  synthetic polypeptide
QQSYDSPL

SEQ ID NO: 965 - protein, 8 aa, Artificial Sequence
  synthetic polypeptide
QQSYDSPL

SEQ ID NO: 966 - protein, 8 aa, Artificial Sequence
  synthetic polypeptide
QQSDNSPL

SEQ ID NO: 967 - protein, 8 aa, Artificial Sequence
  synthetic polypeptide
QQSDDNPL

SEQ ID NO: 968 - protein, 8 aa, Artificial Sequence
  synthetic polypeptide
QQSYESPL

SEQ ID NO: 969 - protein, 8 aa, Artificial Sequence
  synthetic polypeptide
QQSYDTPL

SEQ ID NO: 970 - protein, 8 aa, Artificial Sequence
  synthetic polypeptide
QQSYESPL

SEQ ID NO: 971 - protein, 8 aa, Artificial Sequence
  synthetic polypeptide
QQSYDNPL

SEQ ID NO: 972 - protein, 8 aa, Artificial Sequence
  synthetic polypeptide
QQSYELPL

SEQ ID NO: 973 - protein, 8 aa, Artificial Sequence
  synthetic polypeptide
QQSNELPL

SEQ ID NO: 974 - protein, 8 aa, Artificial Sequence
  synthetic polypeptide
QQSYDTPL

SEQ ID NO: 975 - protein, 8 aa, Artificial Sequence
  synthetic polypeptide
QQSYDLPL

SEQ ID NO: 976 - protein, 8 aa, Artificial Sequence
  synthetic polypeptide
QQSDDSPL

SEQ ID NO: 977 - protein, 8 aa, Artificial Sequence
  synthetic polypeptide
QQSYNLPL

SEQ ID NO: 978 - protein, 8 aa, Artificial Sequence
  synthetic polypeptide
QQSYENPL

SEQ ID NO: 979 - protein, 8 aa, Artificial Sequence
  synthetic polypeptide
QQSYDLPL

SEQ ID NO: 980 - protein, 8 aa, Artificial Sequence
  synthetic polypeptide
QQSYSTPL

SEQ ID NO: 981 - protein, 8 aa, Artificial Sequence
  synthetic polypeptide
QQSYENPL

SEQ ID NO: 982 - protein, 8 aa, Artificial Sequence
  synthetic polypeptide
QQSDSNPL

SEQ ID NO: 983 - protein, 8 aa, Artificial Sequence
  synthetic polypeptide
QQSYDLPL

SEQ ID NO: 984 - protein, 8 aa, Artificial Sequence
  synthetic polypeptide
QQSYENPL

SEQ ID NO: 985 - protein, 8 aa, Artificial Sequence
  synthetic polypeptide
QQSYSTPL

SEQ ID NO: 986 - protein, 8 aa, Artificial Sequence
  synthetic polypeptide
QQSYSSPL

SEQ ID NO: 987 - protein, 8 aa, Artificial Sequence
  synthetic polypeptide
QQSYETPL

SEQ ID NO: 988 - protein, 8 aa, Artificial Sequence
  synthetic polypeptide
QQSDNTPL

SEQ ID NO: 989 - protein, 8 aa, Artificial Sequence
  synthetic polypeptide
QQSYSNPL

SEQ ID NO: 990 - protein, 8 aa, Artificial Sequence
  synthetic polypeptide
QQSYDLPL

SEQ ID NO: 991 - protein, 8 aa, Artificial Sequence
  synthetic polypeptide
QQSYDLPL

SEQ ID NO: 992 - protein, 8 aa, Artificial Sequence
  synthetic polypeptide
QQSYDLPL

SEQ ID NO: 993 - protein, 8 aa, Artificial Sequence
  synthetic polypeptide
QQSYESPL

SEQ ID NO: 994 - protein, 8 aa, Artificial Sequence
  synthetic polypeptide
QQSYDSPL

SEQ ID NO: 995 - protein, 8 aa, Artificial Sequence
  synthetic polypeptide
QQSYDLPL

SEQ ID NO: 996 - protein, 8 aa, Artificial Sequence
  synthetic polypeptide
QQSYDTPL

SEQ ID NO: 997 - protein, 8 aa, Artificial Sequence
  synthetic polypeptide
QQSYENPL

SEQ ID NO: 998 - protein, 8 aa, Artificial Sequence
  synthetic polypeptide
QQSYETPL

SEQ ID NO: 999 - protein, 8 aa, Artificial Sequence
  synthetic polypeptide
QQSYSSPL

SEQ ID NO: 1000 - protein, 8 aa, Artificial Sequence
  synthetic polypeptide
QQSYENPL

SEQ ID NO: 1001 - protein, 8 aa, Artificial Sequence
  synthetic polypeptide
QQSDSLPL

SEQ ID NO: 1002 - protein, 8 aa, Artificial Sequence
  synthetic polypeptide
QQSDNLPL

SEQ ID NO: 1003 - protein, 8 aa, Artificial Sequence
  synthetic polypeptide
QQSYNNPL

SEQ ID NO: 1004 - protein, 8 aa, Artificial Sequence
  synthetic polypeptide
QQSYELPL

SEQ ID NO: 1005 - protein, 8 aa, Artificial Sequence
  synthetic polypeptide
QQSYDTPL

SEQ ID NO: 1006 - protein, 8 aa, Artificial Sequence
  synthetic polypeptide
QQSYDSPL

SEQ ID NO: 1007 - protein, 8 aa, Artificial Sequence
  synthetic polypeptide
QQSDSNPL

SEQ ID NO: 1008 - protein, 8 aa, Artificial Sequence
  synthetic polypeptide
QQSYSLPL

SEQ ID NO: 1009 - protein, 8 aa, Artificial Sequence
  synthetic polypeptide
QQSYESPL

SEQ ID NO: 1010 - protein, 8 aa, Artificial Sequence
  synthetic polypeptide
QQSYDLPL

SEQ ID NO: 1011 - protein, 8 aa, Artificial Sequence
  synthetic polypeptide
QQSYDNPL

SEQ ID NO: 1012 - protein, 8 aa, Artificial Sequence
  synthetic polypeptide
QQSYNLPL

SEQ ID NO: 1013 - protein, 8 aa, Artificial Sequence
  synthetic polypeptide
QQSYDTPL

SEQ ID NO: 1014 - protein, 8 aa, Artificial Sequence
  synthetic polypeptide
QQSDSNPL

SEQ ID NO: 1015 - protein, 8 aa, Artificial Sequence
  synthetic polypeptide
QQSYDSPL

SEQ ID NO: 1016 - protein, 8 aa, Artificial Sequence
  synthetic polypeptide
QQSYESPL

SEQ ID NO: 1017 - protein, 8 aa, Artificial Sequence
  synthetic polypeptide
QQSYDTPL

SEQ ID NO: 1018 - protein, 8 aa, Artificial Sequence
  synthetic polypeptide
QQSYESPL

SEQ ID NO: 1019 - protein, 8 aa, Artificial Sequence
  synthetic polypeptide
QQSYELPL

SEQ ID NO: 1020 - protein, 8 aa, Artificial Sequence
  synthetic polypeptide
QQSYELPL

SEQ ID NO: 1021 - protein, 8 aa, Artificial Sequence
  synthetic polypeptide
QQSYSTPL

SEQ ID NO: 1022 - protein, 8 aa, Artificial Sequence
  synthetic polypeptide
QQSYSNPL

SEQ ID NO: 1023 - protein, 8 aa, Artificial Sequence
  synthetic polypeptide
QQSYSNPL

SEQ ID NO: 1024 - protein, 8 aa, Artificial Sequence
  synthetic polypeptide
QQSYDTPL

SEQ ID NO: 1025 - protein, 8 aa, Artificial Sequence
  synthetic polypeptide
QQSYESPL

SEQ ID NO: 1026 - protein, 120 aa, Artificial Sequence
  synthetic polypeptide
EVQLLESGGGLVQPGGSLRLSCAASGFTFSDYSMNWVRQAPGKGLEWVSGINYNGGYKGYADSVKGRFTISRDNSKNTLYLQMNSLRAEDTAVYYCARGANWHDTHLDYWGQGTLVTVSS

SEQ ID NO: 1027 - protein, 120 aa, Artificial Sequence
  synthetic polypeptide
EVQLLESGGGLVQPGGSLRLSCAASGFTFDSYSMNWVRQAPGKGLEWVSSINYNSGYKGYADSVKGRFTISRDNSKNTLYLQMNSLRAEDTAVYYCARGANWHDTHLDYWGQGTLVTVSS

SEQ ID NO: 1028 - protein, 120 aa, Artificial Sequence
  synthetic polypeptide
EVQLLESGGGLVQPGGSLRLSCAASGFTFSDYGMNWVRQAPGKGLEWVSNINYNGGYTGYADSVKGRFTISRDNSKNTLYLQMNSLRAEDTAVYYCARGANWHDTALDYWGQGTLVTVSS

SEQ ID NO: 1029 - protein, 120 aa, Artificial Sequence
  synthetic polypeptide
EVQLLESGGGLVQPGGSLRLSCAASGFTFSSYSMNWVRQAPGKGLEWVSGINYNGGYKGYADSVKGRFTISRDNSKNTLYLQMNSLRAEDTAVYYCARGANWHDTHLDYWGQGTLVTVSS

SEQ ID NO: 1030 - protein, 120 aa, Artificial Sequence
  synthetic polypeptide
EVQLLESGGGLVQPGGSLRLSCAASGFTFDSYSMNWVRQAPGKGLEWVSSINYNGGYTSYADSVKGRFTISRDNSKNTLYLQMNSLRAEDTAVYYCARGANWHDTHLDYWGQGTLVTVSS

SEQ ID NO: 1031 - protein, 120 aa, Artificial Sequence
  synthetic polypeptide
EVQLLESGGGLVQPGGSLRLSCAASGFTFSSYGMNWVRQAPGKGLEWVAGINYNSGYKGYADSVKGRFTISRDNSKNTLYLQMNSLRAEDTAVYYCARGANWHDTHLDYWGQGTLVTVSS

SEQ ID NO: 1032 - protein, 120 aa, Artificial Sequence
  synthetic polypeptide
EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARGANWHDTHLDYWGQGTLVTVSS

SEQ ID NO: 1033 - protein, 120 aa, Artificial Sequence
  synthetic polypeptide
EVQLLESGGGLVQPGGSLRLSCAASGFTFSSYGMNWVRQAPGKGLEWVSGINYNGGYKGYADSVKGRFTISRDNSKNTLYLQMNSLRAEDTAVYYCARGANWHDTALDYWGQGTLVTVSS

SEQ ID NO: 1034 - protein, 120 aa, Artificial Sequence
  synthetic polypeptide
EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGANWHDTHLDYWGQGTLVTVSS

SEQ ID NO: 1035 - protein, 120 aa, Artificial Sequence
  synthetic polypeptide
EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTHLDYWGQGTLVTVSS

SEQ ID NO: 1036 - protein, 120 aa, Artificial Sequence
  synthetic polypeptide
EVQLLESGGGLVQPGGSLRLSCAASGFTFSDYSMNWVRQAPGKGLEWVASINYNGGYKSYADSVKGRFTISRDNSKNTLYLQMNSLRAEDTAVYYCARGANWHDTHLDYWGQGTLVTVSS

SEQ ID NO: 1037 - protein, 120 aa, Artificial Sequence
  synthetic polypeptide
EVQLLESGGGLVQPGGSLRLSCAASGFTFDDYSMNWVRQAPGKGLEWVSGINYNSGYKGYADSVKGRFTISRDNSKNTLYLQMNSLRAEDTAVYYCARGANWHDTHLDYWGQGTLVTVSS

SEQ ID NO: 1038 - protein, 120 aa, Artificial Sequence
  synthetic polypeptide
EVQLLESGGGLVQPGGSLRLSCAASGFTFSDYSMNWVRQAPGKGLEWVSGINYNSGYKSYADSVKGRFTISRDNSKNTLYLQMNSLRAEDTAVYYCARGANWHDTALDYWGQGTLVTVSS

SEQ ID NO: 1039 - protein, 120 aa, Artificial Sequence
  synthetic polypeptide
EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARGANWHDTHLDYWGQGTLVTVSS

SEQ ID NO: 1040 - protein, 120 aa, Artificial Sequence
  synthetic polypeptide
EVQLLESGGGLVQPGGSLRLSCAASGFTFDSYGMNWVRQAPGKGLEWVSNINYNGGYKSYADSVKGRFTISRDNSKNTLYLQMNSLRAEDTAVYYCARGANWHDTHLDYWGQGTLVTVSS

SEQ ID NO: 1041 - protein, 120 aa, Artificial Sequence
  synthetic polypeptide
EVQLLESGGGLVQPGGSLRLSCAASGFTFSDYSMNWVRQAPGKGLEWVSNINYNGGYTSYADSVKGRFTISRDNSKNTLYLQMNSLRAEDTAVYYCARGANWHDTHLDYWGQGTLVTVSS

SEQ ID NO: 1042 - protein, 120 aa, Artificial Sequence
  synthetic polypeptide
EVQLLESGGGLVQPGGSLRLSCAASGFTFSSYGMNWVRQAPGKGLEWVSGINYNSGYTGYADSVKGRFTISRDNSKNTLYLQMNSLRAEDTAVYYCARGANWHDTHLDYWGQGTLVTVSS

SEQ ID NO: 1043 - protein, 120 aa, Artificial Sequence
  synthetic polypeptide
EVQLLESGGGLVQPGGSLRLSCAASGFTFSSYGMHWVRQAPGKGLEWVSGINYNSGYKGYADSVKGRFTISRDNSKNTLYLQMNSLRAEDTAVYYCARGANWHDTHLDYWGQGTLVTVSS

SEQ ID NO: 1044 - protein, 120 aa, Artificial Sequence; identical to SEQ ID NO: 1040
  synthetic polypeptide

SEQ ID NO: 1045 - protein, 120 aa, Artificial Sequence
  synthetic polypeptide
EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARGANWHDTALDYWGQGTLVTVSS

SEQ ID NO: 1046 - protein, 120 aa, Artificial Sequence
  synthetic polypeptide
EVQLLESGGGLVQPGGSLRLSCAASGFTFDSYGMNWVRQAPGKGLEWVASINYNGGYKGYADSVKGRFTISRDNSKNTLYLQMNSLRAEDTAVYYCARGANWHDTHLDYWGQGTLVTVSS

SEQ ID NO: 1047 - protein, 120 aa, Artificial Sequence
  synthetic polypeptide
EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1048 - protein, 120 aa, Artificial Sequence
  synthetic polypeptide
EVQLLESGGGLVQPGGSLRLSCAASGFTFSSYGMNWVRQAPGKGLEWVAGINYNSGYTSYADSVKGRFTISRDNSKNTLYLQMNSLRAEDTAVYYCARGANWHDTHLDYWGQGTLVTVSS

SEQ ID NO: 1049 - protein, 120 aa, Artificial Sequence
  synthetic polypeptide
EVQLLESGGGLVQPGGSLRLSCAASGFTFSSYGMNWVRQAPGKGLEWVSGINYNSGYTSYADSVKGRFTISRDNSKNTLYLQMNSLRAEDTAVYYCARGANWHDTHLDYWGQGTLVTVSS

SEQ ID NO: 1050 - protein, 120 aa, Artificial Sequence
  synthetic polypeptide
EVQLLESGGGLVQPGGSLRLSCAASGFTFSSYSMNWVRQAPGKGLEWVAGINYNGGYKGYADSVKGRFTISRDNSKNTLYLQMNSLRAEDTAVYYCARGANWHDTALDYWGQGTLVTVSS

SEQ ID NO: 1051 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARGANWHDTHLDYWGQGTLVTVSS

SEQ ID NO: 1052 - protein, 120 aa, Artificial Sequence
  synthetic polypeptide
EVQLLESGGGLVQPGGSLRLSCAASGFTFSSYGMHWVRQAPGKGLEWVASINYNGGYKSYADSVKGRFTISRDNSKNTLYLQMNSLRAEDTAVYYCARGANWHDTHLDYWGQGTLVTVSS

SEQ ID NO: 1053 - protein, 120 aa, Artificial Sequence
  synthetic polypeptide
EVQLLESGGGLVQPGGSLRLSCAASGFTFSSYSMNWVRQAPGKGLEWVSSINYNSGYTGYADSVKGRFTISRDNSKNTLYLQMNSLRAEDTAVYYCARGANWHDTHLDYWGQGTLVTVSS

SEQ ID NO: 1054 - protein, 120 aa, Artificial Sequence
  synthetic polypeptide
EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARGANWHDTALDYWGQGTLVTVSS

SEQ ID NO: 1055 - protein, 120 aa, Artificial Sequence
  synthetic polypeptide
EVQLLESGGGLVQPGGSLRLSCAASGFTFDSYSMNWVRQAPGKGLEWVSSINYNGGYTGYADSVKGRFTISRDNSKNTLYLQMNSLRAEDTAVYYCARGANWHDTHLDYWGQGTLVTVSS

SEQ ID NO: 1056 - protein, 120 aa, Artificial Sequence
  synthetic polypeptide
EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1057 - protein, 120 aa, Artificial Sequence
  synthetic polypeptide
EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1058 - protein, 120 aa, Artificial Sequence
  synthetic polypeptide
EVQLLESGGGLVQPGGSLRLSCAASGFTFSSYSMNWVRQAPGKGLEWVSSINYNGGYTGYADSVKGRFTISRDNSKNTLYLQMNSLRAEDTAVYYCARGANWHDTHLDYWGQGTLVTVSS

SEQ ID NO: 1059 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1060 - protein, 120 aa, Artificial Sequence
  synthetic polypeptide
EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARGANWHDTHLDYWGQGTLVTVSS

SEQ ID NO: 1061 - protein, 120 aa, Artificial Sequence
  synthetic polypeptide
EVQLLESGGGLVQPGGSLRLSCAASGFTFDSYGMNWVRQAPGKGLEWVASINYNSGYTGYADSVKGRFTISRDNSKNTLYLQMNSLRAEDTAVYYCARGANWHDTHLDYWGQGTLVTVSS

SEQ ID NO: 1062 - protein, 120 aa, Artificial Sequence
  synthetic polypeptide
EVQLLESGGGLVQPGGSLRLSCAASGFTFSSYSMNWVRQAPGKGLEWVAGINYNSGYTSYADSVKGRFTISRDNSKNTLYLQMNSLRAEDTAVYYCARGANWHDTHLDYWGQGTLVTVSS

SEQ ID NO: 1063 - protein, 120 aa, Artificial Sequence
  synthetic polypeptide
EVQLLESGGGLVQPGGSLRLSCAASGFTFDSYGMNWVRQAPGKGLEWVSSINYNGGYTGYADSVKGRFTISRDNSKNTLYLQMNSLRAEDTAVYYCARGANWHDTHLDYWGQGTLVTVSS

SEQ ID NO: 1064 - protein, 120 aa, Artificial Sequence; identical to SEQ ID NO: 1048
  synthetic polypeptide

SEQ ID NO: 1065 - protein, 120 aa, Artificial Sequence
  synthetic polypeptide
EVQLLESGGGLVQPGGSLRLSCAASGFTFSSYSMNWVRQAPGKGLEWVSGINYNGGYTGYADSVKGRFTISRDNSKNTLYLQMNSLRAEDTAVYYCARGANWHDTHLDYWGQGTLVTVSS

SEQ ID NO: 1066 - protein, 120 aa, Artificial Sequence
  synthetic polypeptide
EVQLLESGGGLVQPGGSLRLSCAASGFTFDDYSMNWVRQAPGKGLEWVAGINYNGGYKSYADSVKGRFTISRDNSKNTLYLQMNSLRAEDTAVYYCARGANWHDTHLDYWGQGTLVTVSS

SEQ ID NO: 1067 - protein, 120 aa, Artificial Sequence
  synthetic polypeptide
EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARGANWHDTHLDYWGQGTLVTVSS

SEQ ID NO: 1068 - protein, 120 aa, Artificial Sequence
  synthetic polypeptide
EVQLLESGGGLVQPGGSLRLSCAASGFTFDDYSMNWVRQAPGKGLEWVANINYNGGYKGYADSVKGRFTISRDNSKNTLYLQMNSLRAEDTAVYYCARGANWHDTHLDYWGQGTLVTVSS

SEQ ID NO: 1069 - protein, 120 aa, Artificial Sequence
  synthetic polypeptide
EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTHLDYWGQGTLVTVSS

SEQ ID NO: 1070 - protein, 120 aa, Artificial Sequence
  synthetic polypeptide
EVQLLESGGGLVQPGGSLRLSCAASGFTFSDYGMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1071 - protein, 120 aa, Artificial Sequence; identical to SEQ ID NO: 1049
  synthetic polypeptide

SEQ ID NO: 1072 - protein, 120 aa, Artificial Sequence
  synthetic polypeptide
EVQLLESGGGLVQPGGSLRLSCAASGFTFSSYGMNWVRQAPGKGLEWVAGINYNSGYTSYADSVKGRFTISRDNSKNTLYLQMNSLRAEDTAVYYCARGANWHDTALDYWGQGTLVTVSS

SEQ ID NO: 1073 - protein, 120 aa, Artificial Sequence
  synthetic polypeptide
EVQLLESGGGLVQPGGSLRLSCAASGFTFSSYSMNWVRQAPGKGLEWVANINYNGGYKSYADSVKGRFTISRDNSKNTLYLQMNSLRAEDTAVYYCARGANWHDTHLDYWGQGTLVTVSS

SEQ ID NO: 1074 - protein, 120 aa, Artificial Sequence; identical to SEQ ID NO: 1050
  synthetic polypeptide

SEQ ID NO: 1075 - protein, 120 aa, Artificial Sequence
  synthetic polypeptide
EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARGANWHDTHLDYWGQGTLVTVSS

SEQ ID NO: 1076 - protein, 120 aa, Artificial Sequence
  synthetic polypeptide
EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGANWHDTALDYWGQGTLVTVSS

SEQ ID NO: 1077 - protein, 120 aa, Artificial Sequence
  synthetic polypeptide
EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTHLDYWGQGTLVTVSS

SEQ ID NO: 1078 - protein, 120 aa, Artificial Sequence
  synthetic polypeptide
EVQLLESGGGLVQPGGSLRLSCAASGFTFSSYGMNWVRQAPGKGLEWVSGINYNGGYKSYADSVKGRFTISRDNSKNTLYLQMNSLRAEDTAVYYCARGANWHDTHLDYWGQGTLVTVSS

SEQ ID NO: 1079 - protein, 120 aa, Artificial Sequence
  synthetic polypeptide
EVQLLESGGGLVQPGGSLRLSCAASGFTFSDYGMNWVRQAPGKGLEWVSNINYNGGYTSYADSVKGRFTISRDNSKNTLYLQMNSLRAEDTAVYYCARGANWHDTALDYWGQGTLVTVSS

SEQ ID NO: 1080 - protein, 120 aa, Artificial Sequence
  synthetic polypeptide
EVQLLESGGGLVQPGGSLRLSCAASGFTFSSYGMNWVRQAPGKGLEWVSGINYNGGYTSYADSVKGRFTISRDNSKNTLYLQMNSLRAEDTAVYYCARGANWHDTALDYWGQGTLVTVSS

SEQ ID NO: 1081 - protein, 120 aa, Artificial Sequence
  synthetic polypeptide
EVQLLESGGGLVQPGGSLRLSCAASGFTFSDYGMHWVRQAPGKGLEWVSGINYNSGYTSYADSVKGRFTISRDNSKNTLYLQMNSLRAEDTAVYYCARGANWHDTALDYWGQGTLVTVSS

SEQ ID NO: 1082 - protein, 120 aa, Artificial Sequence
  synthetic polypeptide
EVQLLESGGGLVQPGGSLRLSCAASGFTFDSYSMNWVRQAPGKGLEWVSSINYNGGYKGYADSVKGRFTISRDNSKNTLYLQMNSLRAEDTAVYYCARGANWHDTHLDYWGQGTLVTVSS

SEQ ID NO: 1083 - protein, 120 aa, Artificial Sequence
  synthetic polypeptide
EVQLLESGGGLVQPGGSLRLSCAASGFTFDSYGMNWVRQAPGKGLEWVAGINYNGGYTGYADSVKGRFTISRDNSKNTLYLQMNSLRAEDTAVYYCARGANWHDTALDYWGQGTLVTVSS

SEQ ID NO: 1084 - protein, 120 aa, Artificial Sequence
  synthetic polypeptide
EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARGANWHDTALDYWGQGTLVTVSS

SEQ ID NO: 1085 - protein, 120 aa, Artificial Sequence
  synthetic polypeptide
EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARGANWHDTHLDYWGQGTLVTVSS

SEQ ID NO: 1086 - protein, 120 aa, Artificial Sequence
  synthetic polypeptide
EVQLLESGGGLVQPGGSLRLSCAASGFTFSDYSMNWVRQAPGKGLEWVSGINYNGGYKGYADSVKGRFTISRDNSKNTLYLQMNSLRAEDTAVYYCARGANWHDTALDYWGQGTLVTVSS

SEQ ID NO: 1087 - protein, 120 aa, Artificial Sequence
  synthetic polypeptide
EVQLLESGGGLVQPGGSLRLSCAASGFTFSSYSMNWVRQAPGKGLEWVSSINYNGGYTGYADSVKGRFTISRDNSKNTLYLQMNSLRAEDTAVYYCARGANWHDTALDYWGQGTLVTVSS

SEQ ID NO: 1088 - protein, 120 aa, Artificial Sequence
  synthetic polypeptide
EVQLLESGGGLVQPGGSLRLSCAASGFTFDDYSMNWVRQAPGKGLEWVSNINYNGGYKGYADSVKGRFTISRDNSKNTLYLQMNSLRAEDTAVYYCARGANWHDTALDYWGQGTLVTVSS

SEQ ID NO: 1089 - protein, 120 aa, Artificial Sequence
  synthetic polypeptide
EVQLLESGGGLVQPGGSLRLSCAASGFTFSSYGMNWVRQAPGKGLEWVSSINYNSGYKSYADSVKGRFTISRDNSKNTLYLQMNSLRAEDTAVYYCARGANWHDTALDYWGQGTLVTVSS

SEQ ID NO: 1090 - protein, 120 aa, Artificial Sequence; identical to SEQ ID NO: 1085
  synthetic polypeptide

SEQ ID NO: 1091 - protein, 120 aa, Artificial Sequence
  synthetic polypeptide
EVQLLESGGGLVQPGGSLRLSCAASGFTFSSYSMNWVRQAPGKGLEWVAGINYNGGYKSYADSVKGRFTISRDNSKNTLYLQMNSLRAEDTAVYYCARGANWHDTALDYWGQGTLVTVSS

SEQ ID NO: 1092 - protein, 120 aa, Artificial Sequence
  synthetic polypeptide
EVQLLESGGGLVQPGGSLRLSCAASGFTFDDYSMNWVRQAPGKGLEWVSGINYNGGYKGYADSVKGRFTISRDNSKNTLYLQMNSLRAEDTAVYYCARGANWHDTALDYWGQGTLVTVSS

SEQ ID NO: 1093 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARGANWHDTHLDYWGQGTLVTVSS

SEQ ID NO: 1094 - protein, 120 aa, Artificial Sequence
  synthetic polypeptide
EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGANWHDTALDYWGQGTLVTVSS

SEQ ID NO: 1095 - protein, 120 aa, Artificial Sequence
  synthetic polypeptide
EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARGANWHDTHLDYWGQGTLVTVSS

SEQ ID NO: 1096 - protein, 120 aa, Artificial Sequence
  synthetic polypeptide
EVQLLESGGGLVQPGGSLRLSCAASGFTFSDYSMNWVRQAPGKGLEWVAGINYNSGYTSYADSVKGRFTISRDNSKNTLYLQMNSLRAEDTAVYYCARGANWHDTALDYWGQGTLVTVSS

SEQ ID NO: 1097 - protein, 120 aa, Artificial Sequence
  synthetic polypeptide
EVQLLESGGGLVQPGGSLRLSCAASGFTFSSYGMHWVRQAPGKGLEWVSSINYNGGYTGYADSVKGRFTISRDNSKNTLYLQMNSLRAEDTAVYYCARGANWHDTHLDYWGQGTLVTVSS

SEQ ID NO: 1098 - protein, 120 aa, Artificial Sequence
  synthetic polypeptide
EVQLLESGGGLVQPGGSLRLSCAASGFTFDSYGMNWVRQAPGKGLEWVSGINYNSGYKGYADSVKGRFTISRDNSKNTLYLQMNSLRAEDTAVYYCARGANWHDTALDYWGQGTLVTVSS

SEQ ID NO: 1099 - protein, 120 aa, Artificial Sequence
  synthetic polypeptide
EVQLLESGGGLVQPGGSLRLSCAASGFTFSDYGMHWVRQAPGKGLEWVANINYNGGYTGYADSVKGRFTISRDNSKNTLYLQMNSLRAEDTAVYYCARGANWHDTALDYWGQGTLVTVSS

SEQ ID NO: 1100 - protein, 120 aa, Artificial Sequence
  synthetic polypeptide
EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGANWHDTHLDYWGQGTLVTVSS

SEQ ID NO: 1101 - protein, 120 aa, Artificial Sequence
  synthetic polypeptide
EVQLLESGGGLVQPGGSLRLSCAASGFTFDDYSMNWVRQAPGKGLEWVAGINYNGGYKSYADSVKGRFTISRDNSKNTLYLQMNSLRAEDTAVYYCARGANWHDTALDYWGQGTLVTVSS

SEQ ID NO: 1102 - protein, 120 aa, Artificial Sequence
  synthetic polypeptide
EVQLLESGGGLVQPGGSLRLSCAASGFTFDDYSMNWVRQAPGKGLEWVAGINYNGGYTGYADSVKGRFTISRDNSKNTLYLQMNSLRAEDTAVYYCARGANWHDTHLDYWGQGTLVTVSS

SEQ ID NO: 1103 - protein, 120 aa, Artificial Sequence
  synthetic polypeptide
EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGANWHDTALDYWGQGTLVTVSS

SEQ ID NO: 1104 - protein, 120 aa, Artificial Sequence; identical to SEQ ID NO: 1076
  synthetic polypeptide

SEQ ID NO: 1105 - protein, 120 aa, Artificial Sequence; identical to SEQ ID NO: 1076
  synthetic polypeptide

SEQ ID NO: 1106 - protein, 120 aa, Artificial Sequence
  synthetic polypeptide
EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARGANWHDTALDYWGQGTLVTVSS

SEQ ID NO: 1107 - protein, 120 aa, Artificial Sequence; identical to SEQ ID NO: 1103
  synthetic polypeptide

SEQ ID NO: 1108 - protein, 120 aa, Artificial Sequence
  synthetic polypeptide
EVQLLESGGGLVQPGGSLRLSCAASGFTFDSYGMNWVRQAPGKGLEWVASINYNGGYTSYADSVKGRFTISRDNSKNTLYLQMNSLRAEDTAVYYCARGANWHDTHLDYWGQGTLVTVSS

SEQ ID NO: 1109 - protein, 120 aa, Artificial Sequence
  synthetic polypeptide
EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARGANWHDTALDYWGQGTLVTVSS

SEQ ID NO: 1110 - protein, 120 aa, Artificial Sequence; identical to SEQ ID NO: 1084
  synthetic polypeptide

SEQ ID NO: 1111 - protein, 120 aa, Artificial Sequence
  synthetic polypeptide
EVQLLESGGGLVQPGGSLRLSCAASGFTFSSYGMNWVRQAPGKGLEWVSNINYNSGYTSYADSVKGRFTISRDNSKNTLYLQMNSLRAEDTAVYYCARGANWHDTALDYWGQGTLVTVSS

SEQ ID NO: 1112 - protein, 120 aa, Artificial Sequence
  synthetic polypeptide
EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARGANWHDTALDYWGQGTLVTVSS

SEQ ID NO: 1113 - protein, 120 aa, Artificial Sequence
  synthetic polypeptide
EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARGANWHDTALDYWGQGTLVTVSS

SEQ ID NO: 1114 - protein, 120 aa, Artificial Sequence
  synthetic polypeptide
EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARGANWHDTALDYWGQGTLVTVSS

SEQ ID NO: 1115 - protein, 120 aa, Artificial Sequence
  synthetic polypeptide
EVQLLESGGGLVQPGGSLRLSCAASGFTFSSYGMNWVRQAPGKGLEWVASINYNGGYKGYADSVKGRFTISRDNSKNTLYLQMNSLRAEDTAVYYCARGANWHDTHLDYWGQGTLVTVSS

SEQ ID NO: 1116 - protein, 120 aa, Artificial Sequence; identical to SEQ ID NO: 1100
  synthetic polypeptide

SEQ ID NO: 1117 - protein, 120 aa, Artificial Sequence
  synthetic polypeptide
EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARGANWHDTALDYWGQGTLVTVSS

SEQ ID NO: 1118 - protein, 120 aa, Artificial Sequence
  synthetic polypeptide
EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARGANWHDTALDYWGQGTLVTVSS

SEQ ID NO: 1119 - protein, 120 aa, Artificial Sequence
  synthetic polypeptide
EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGANWHDTALDYWGQGTLVTVSS

SEQ ID NO: 1120 - protein, 120 aa, Artificial Sequence; identical to SEQ ID NO: 1092
  synthetic polypeptide

SEQ ID NO: 1121 - protein, 120 aa, Artificial Sequence; identical to SEQ ID NO: 1032
  synthetic polypeptide

SEQ ID NO: 1122 - protein, 120 aa, Artificial Sequence
  synthetic polypeptide
EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARGANWHDTHLDYWGQGTLVTVSS

SEQ ID NO: 1123 - protein, 120 aa, Artificial Sequence
  synthetic polypeptide
EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARGANWHDTALDYWGQGTLVTVSS

SEQ ID NO: 1124 - protein, 120 aa, Artificial Sequence
  synthetic polypeptide
EVQLLESGGGLVQPGGSLRLSCAASGFTFSDYSMNWVRQAPGKGLEWVSGINYNSGYKSYADSVKGRFTISRDNSKNTLYLQMNSLRAEDTAVYYCARGANWHDTHLDYWGQGTLVTVSS

SEQ ID NO: 1125 - protein, 120 aa, Artificial Sequence; identical to SEQ ID NO: 1076
  synthetic polypeptide

SEQ ID NO: 1126 - protein, 120 aa, Artificial Sequence
  synthetic polypeptide
EVQLLESGGGLVQPGGSLRLSCAASGFTFSNYGMNWVRQAPGKGLEWVANINYNGGYTGYADSVKGRFTISRDNSKNTLYLQMNSLRAEDTAVYYCARGANWHDTALDYWGQGTLVTVSS

SEQ ID NO: 1127 - protein, 120 aa, Artificial Sequence
  synthetic polypeptide
EVQLLESGGGLVQPGGSLRLSCAASGFTFSSYSMNWVRQAPGKGLEWVSSINYNGGYTSYADSVKGRFTISRDNSKNTLYLQMNSLRAEDTAVYYCARGANWHDTALDYWGQGTLVTVSS

SEQ ID NO: 1128 - protein, 120 aa, Artificial Sequence
  synthetic polypeptide
EVQLLESGGGLVQPGGSLRLSCAASGFTFSDYSMNWVRQAPGKGLEWVSNINYNGGYKSYADSVKGRFTISRDNSKNTLYLQMNSLRAEDTAVYYCARGANWHDTALDYWGQGTLVTVSS

SEQ ID NO: 1129 - protein, 120 aa, Artificial Sequence; identical to SEQ ID NO: 1054
  synthetic polypeptide

SEQ ID NO: 1130 - protein, 120 aa, Artificial Sequence; identical to SEQ ID NO: 1094
  synthetic polypeptide

SEQ ID NO: 1131 - protein, 120 aa, Artificial Sequence
  synthetic polypeptide
EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARGANWHDTHLDYWGQGTLVTVSS

SEQ ID NO: 1132 - protein, 120 aa, Artificial Sequence
  synthetic polypeptide
EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTALDYWGQGTLVTVSS

SEQ ID NO: 1133 - protein, 120 aa, Artificial Sequence; identical to SEQ ID NO: 1103
  synthetic polypeptide

SEQ ID NO: 1134 - protein, 120 aa, Artificial Sequence; identical to SEQ ID NO: 1027
  synthetic polypeptide

SEQ ID NO: 1135 - protein, 120 aa, Artificial Sequence; identical to SEQ ID NO: 1118
  synthetic polypeptide

SEQ ID NO: 1136 - protein, 120 aa, Artificial Sequence; identical to SEQ ID NO: 1103
  synthetic polypeptide

SEQ ID NO: 1137 - protein, 120 aa, Artificial Sequence
  synthetic polypeptide
EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCARGANWHDTHLDYWGQGTLVTVSS

SEQ ID NO: 1138 - protein, 120 aa, Artificial Sequence
  synthetic polypeptide
EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARGANWHDTALDYWGQGTLVTVSS

SEQ ID NO: 1139 - protein, 120 aa, Artificial Sequence
  synthetic polypeptide
EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARGANWHDTALDYWGQGTLVTVSS

SEQ ID NO: 1140 - protein, 120 aa, Artificial Sequence
  synthetic polypeptide
EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARGANWHDTALDYWGQGTLVTVSS

SEQ ID NO: 1141 - protein, 120 aa, Artificial Sequence
  synthetic polypeptide
EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGANWHDTHLDYWGQGTLVTVSS

SEQ ID NO: 1142 - protein, 120 aa, Artificial Sequence
  synthetic polypeptide
EVQLLESGGGLVQPGGSLRLSCAASGFTFSSYGMNWVRQAPGKGLEWVASINYNSGYKSYADSVKGRFTISRDNSKNTLYLQMNSLRAEDTAVYYCARGANWHDTHLDYWGQGTLVTVSS

SEQ ID NO: 1143 - protein, 120 aa, Artificial Sequence
  synthetic polypeptide
EVQLLESGGGLVQPGGSLRLSCAASGFTFSSYSMNWVRQAPGKGLEWVSSINYNSGYTSYADSVKGRFTISRDNSKNTLYLQMNSLRAEDTAVYYCARGANWHDTHLDYWGQGTLVTVSS

SEQ ID NO: 1144 - protein, 120 aa, Artificial Sequence
  synthetic polypeptide
EVQLLESGGGLVQPGGSLRLSCAASGFTFSSYSMNWVRQAPGKGLEWVSSINYNGGYKGYADSVKGRFTISRDNSKNTLYLQMNSLRAEDTAVYYCARGANWHDTHLDYWGQGTLVTVSS

SEQ ID NO: 1145 - protein, 120 aa, Artificial Sequence; identical to SEQ ID NO: 1054
  synthetic polypeptide

SEQ ID NO: 1146 - protein, 120 aa, Artificial Sequence
  synthetic polypeptide
EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARGANWHDTALDYWGQGTLVTVSS

SEQ ID NO: 1147 - protein, 120 aa, Artificial Sequence; identical to SEQ ID NO: 1076
  synthetic polypeptide

SEQ ID NO: 1148 - protein, 120 aa, Artificial Sequence; identical to SEQ ID NO: 1143
  synthetic polypeptide

SEQ ID NO: 1149 - protein, 120 aa, Artificial Sequence
  synthetic polypeptide
EVQLLESGGGLVQPGGSLRLSCAASGFTFDSYGMNWVRQAPGKGLEWVSGINYNSGYKSYADSVKGRFTISRDNSKNTLYLQMNSLRAEDTAVYYCARGANWHDTALDYWGQGTLVTVSS

SEQ ID NO: 1150 - protein, 120 aa, Artificial Sequence
  synthetic polypeptide
EVQLLESGGGLVQPGGSLRLSCAASGFTFDSYGMNWVRQAPGKGLEWVSSINYNGGYKGYADSVKGRFTISRDNSKNTLYLQMNSLRAEDTAVYYCARGANWHDTHLDYWGQGTLVTVSS

SEQ ID NO: 1151 - protein, 120 aa, Artificial Sequence; identical to SEQ ID NO: 1091
  synthetic polypeptide

SEQ ID NO: 1152 - protein, 120 aa, Artificial Sequence
  synthetic polypeptide
EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARGANWHDTHLDYWGQGTLVTVSS

SEQ ID NO: 1153 - protein, 120 aa, Artificial Sequence
  synthetic polypeptide
EVQLLESGGGLVQPGGSLRLSCAASGFTFDSYSMNWVRQAPGKGLEWVSGINYNSGYTGYADSVKGRFTISRDNSKNTLYLQMNSLRAEDTAVYYCARGANWHDTHLDYWGQGTLVTVSS

SEQ ID NO: 1154 - protein, 120 aa, Artificial Sequence; identical to SEQ ID NO: 1103
  synthetic polypeptide

SEQ ID NO: 1155 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARGANWHDTALDYWGQGTLVTVSS

SEQ ID NO: 1156 - protein, 120 aa, Artificial Sequence; identical to SEQ ID NO: 1093
  synthetic polypeptide

SEQ ID NO: 1157 - protein, 120 aa, Artificial Sequence; identical to SEQ ID NO: 1094
  synthetic polypeptide

SEQ ID NO: 1158 - protein, 120 aa, Artificial Sequence; identical to SEQ ID NO: 1094
  synthetic polypeptide

SEQ ID NO: 1159 - protein, 120 aa, Artificial Sequence; identical to SEQ ID NO: 1103
  synthetic polypeptide

SEQ ID NO: 1160 - protein, 120 aa, Artificial Sequence
  synthetic polypeptide
EVQLLESGGGLVQPGGSLRLSCAASGFTFDSYSMNWVRQAPGKGLEWVASINYNGGYTGYADSVKGRFTISRDNSKNTLYLQMNSLRAEDTAVYYCARGANWHDTHLDYWGQGTLVTVSS

SEQ ID NO: 1161 - protein, 120 aa, Artificial Sequence; identical to SEQ ID NO: 1109
  synthetic polypeptide

SEQ ID NO: 1162 - protein, 120 aa, Artificial Sequence; identical to SEQ ID NO: 1118
  synthetic polypeptide

SEQ ID NO: 1163 - protein, 120 aa, Artificial Sequence; identical to SEQ ID NO: 1054
  synthetic polypeptide

SEQ ID NO: 1164 - protein, 120 aa, Artificial Sequence
  synthetic polypeptide
EVQLLESGGGLVQPGGSLRLSCAASGFTFSSYSMNWVRQAPGKGLEWVAGINYNGGYKGYADSVKGRFTISRDNSKNTLYLQMNSLRAEDTAVYYCARGANWHDTHLDYWGQGTLVTVSS

SEQ ID NO: 1165 - protein, 120 aa, Artificial Sequence; identical to SEQ ID NO: 1143
  synthetic polypeptide

SEQ ID NO: 1166 - protein, 120 aa, Artificial Sequence; identical to SEQ ID NO: 1118
  synthetic polypeptide

SEQ ID NO: 1167 - protein, 120 aa, Artificial Sequence; identical to SEQ ID NO: 1056
  synthetic polypeptide

SEQ ID NO: 1168 - protein, 120 aa, Artificial Sequence; identical to SEQ ID NO: 1103
  synthetic polypeptide

SEQ ID NO: 1169 - protein, 120 aa, Artificial Sequence; identical to SEQ ID NO: 1076
  synthetic polypeptide

SEQ ID NO: 1170 - protein, 120 aa, Artificial Sequence
  synthetic polypeptide
EVQLLESGGGLVQPGGSLRLSCAASGFTFDSYSMNWVRQAPGKGLEWVSSINYNSGYTGYADSVKGRFTISRDNSKNTLYLQMNSLRAEDTAVYYCARGANWHDTHLDYWGQGTLVTVSS

SEQ ID NO: 1171 - protein, 120 aa, Artificial Sequence
  synthetic polypeptide
EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARGANWHDTALDYWGQGTLVTVSS

SEQ ID NO: 1172 - protein, 120 aa, Artificial Sequence; identical to SEQ ID NO: 1140
  synthetic polypeptide

SEQ ID NO: 1173 - protein, 120 aa, Artificial Sequence
  synthetic polypeptide
EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARGANWHDTALDYWGQGTLVTVSS

SEQ ID NO: 1174 - protein, 120 aa, Artificial Sequence
  synthetic polypeptide
EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARGANWHDTALDYWGQGTLVTVSS

SEQ ID NO: 1175 - protein, 120 aa, Artificial Sequence
  synthetic polypeptide
EVQLLESGGGLVQPGGSLRLSCAASGFTFSSYSMNWVRQAPGKGLEWVSGINYNGGYTGYADSVKGRFTISRDNSKNTLYLQMNSLRAEDTAVYYCARGANWHDTALDYWGQGTLVTVSS

SEQ ID NO: 1176 - protein, 120 aa, Artificial Sequence; identical to SEQ ID NO: 1132
  synthetic polypeptide

SEQ ID NO: 1177 - protein, 120 aa, Artificial Sequence; identical to SEQ ID NO: 1174
  synthetic polypeptide

SEQ ID NO: 1178 - protein, 120 aa, Artificial Sequence
  synthetic polypeptide
EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARGANWHDTHLDYWGQGTLVTVSS

SEQ ID NO: 1179 - protein, 120 aa, Artificial Sequence; identical to SEQ ID NO: 1132
  synthetic polypeptide

SEQ ID NO: 1180 - protein, 120 aa, Artificial Sequence; identical to SEQ ID NO: 1094
  synthetic polypeptide

SEQ ID NO: 1181 - protein, 120 aa, Artificial Sequence; identical to SEQ ID NO: 1103
  synthetic polypeptide

SEQ ID NO: 1182 - protein, 120 aa, Artificial Sequence
  synthetic polypeptide
EVQLLESGGGLVQPGGSLRLSCAASGFTFSSYSMNWVRQAPGKGLEWVASINYNSGYTSYADSVKGRFTISRDNSKNTLYLQMNSLRAEDTAVYYCARGANWHDTHLDYWGQGTLVTVSS

SEQ ID NO: 1183 - protein, 120 aa, Artificial Sequence
  synthetic polypeptide
EVQLLESGGGLVQPGGSLRLSCAASGFTFSDYSMNWVRQAPGKGLEWVSNINYNGGYTGYADSVKGRFTISRDNSKNTLYLQMNSLRAEDTAVYYCARGANWHDTALDYWGQGTLVTVSS

SEQ ID NO: 1184 - protein, 120 aa, Artificial Sequence
  synthetic polypeptide
EVQLLESGGGLVQPGGSLRLSCAASGFTFSSYGMNWVRQAPGKGLEWVSSINYNSGYKSYADSVKGRFTISRDNSKNTLYLQMNSLRAEDTAVYYCARGANWHDTHLDYWGQGTLVTVSS

SEQ ID NO: 1185 - protein, 120 aa, Artificial Sequence
  synthetic polypeptide
EVQLLESGGGLVQPGGSLRLSCAASGFTFSSYGMNWVRQAPGKGLEWVASINYNSGYTGYADSVKGRFTISRDNSKNTLYLQMNSLRAEDTAVYYCARGANWHDTHLDYWGQGTLVTVSS

SEQ ID NO: 1186 - protein, 120 aa, Artificial Sequence; identical to SEQ ID NO: 1132
  synthetic polypeptide

SEQ ID NO: 1187 - protein, 120 aa, Artificial Sequence; identical to SEQ ID NO: 1138
  synthetic polypeptide

SEQ ID NO: 1188 - protein, 120 aa, Artificial Sequence; identical to SEQ ID NO: 1132
  synthetic polypeptide

SEQ ID NO: 1189 - protein, 120 aa, Artificial Sequence
  synthetic polypeptide
EVQLLESGGGLVQPGGSLRLSCAASGFTFSSYGMNWVRQAPGKGLEWVAGINYNGGYTGYADSVKGRFTISRDNSKNTLYLQMNSLRAEDTAVYYCARGANWHDTALDYWGQGTLVTVSS

SEQ ID NO: 1190 - protein, 120 aa, Artificial Sequence; identical to SEQ ID NO: 1119
  synthetic polypeptide

SEQ ID NO: 1191 - protein, 120 aa, Artificial Sequence
  synthetic polypeptide
EVQLLESGGGLVQPGGSLRLSCAASGFTFSDYSMNWVRQAPGKGLEWVAGINYNGGYKGYADSVKGRFTISRDNSKNTLYLQMNSLRAEDTAVYYCARGANWHDTALDYWGQGTLVTVSS

SEQ ID NO: 1192 - protein, 120 aa, Artificial Sequence; identical to SEQ ID NO: 1112
  synthetic polypeptide

SEQ ID NO: 1193 - protein, 120 aa, Artificial Sequence
  synthetic polypeptide
EVQLLESGGGLVQPGGSLRLSCAASGFTFDSYSMNWVRQAPGKGLEWVAGINYNSGYTGYADSVKGRFTISRDNSKNTLYLQMNSLRAEDTAVYYCARGANWHDTHLDYWGQGTLVTVSS

SEQ ID NO: 1194 - protein, 120 aa, Artificial Sequence; identical to SEQ ID NO: 1035
  synthetic polypeptide

SEQ ID NO: 1195 - protein, 120 aa, Artificial Sequence; identical to SEQ ID NO: 1050
  synthetic polypeptide

SEQ ID NO: 1196 - protein, 120 aa, Artificial Sequence; identical to SEQ ID NO: 1103
  synthetic polypeptide

SEQ ID NO: 1197 - protein, 120 aa, Artificial Sequence
  synthetic polypeptide
EVQLLESGGGLVQPGGSLRLSCAASGFTFSDYSMNWVRQAPGKGLEWVAGINYNGGYKSYADSVKGRFTISRDNSKNTLYLQMNSLRAEDTAVYYCARGANWHDTALDYWGQGTLVTVSS

SEQ ID NO: 1198 - protein, 120 aa, Artificial Sequence
  synthetic polypeptide
EVQLLESGGGLVQPGGSLRLSCAASGFTFSSYGMNWVRQAPGKGLEWVSGINYNGGYTGYADSVKGRFTISRDNSKNTLYLQMNSLRAEDTAVYYCARGANWHDTHLDYWGQGTLVTVSS

SEQ ID NO: 1199 - protein, 120 aa, Artificial Sequence; identical to SEQ ID NO: 1132
  synthetic polypeptide

SEQ ID NO: 1200 - protein, 120 aa, Artificial Sequence
  synthetic polypeptide
EVQLLESGGGLVQPGGSLRLSCAASGFTFSSYGMNWVRQAPGKGLEWVAGINYNGGYTGYADSVKGRFTISRDNSKNTLYLQMNSLRAEDTAVYYCARGANWHDTHLDYWGQGTLVTVSS

SEQ ID NO: 1201 - protein, 120 aa, Artificial Sequence; identical to SEQ ID NO: 1045
  synthetic polypeptide

SEQ ID NO: 1202 - protein, 120 aa, Artificial Sequence; identical to SEQ ID NO: 1191
  synthetic polypeptide

SEQ ID NO: 1203 - protein, 120 aa, Artificial Sequence; identical to SEQ ID NO: 1050
  synthetic polypeptide

SEQ ID NO: 1204 - protein, 120 aa, Artificial Sequence
  synthetic polypeptide
EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARGANWHDTALDYWGQGTLVTVSS

SEQ ID NO: 1205 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYNSPLTFGGGTKVEIK

SEQ ID NO: 1206 - protein, 107 aa, Artificial Sequence [sequence omitted]

SEQ ID NO: 1207 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYETPLTFGGGTKVEIK

SEQ ID NO: 1208 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSYDTPLTFGGGTKVEIK

SEQ ID NO: 1209 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYDNPLTFGGGTKVEIK

SEQ ID NO: 1210 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYNTPLTFGGGTKVEIK

SEQ ID NO: 1211 - protein, 107 aa, Artificial Sequence
  synthetic polypeptide
DIQMTQSPSSLSASVGDRVTITCRASQSIVSYVNWYQQKPGKAPKLVIYAATSLASGVPSRFSGSGSGTDFTLTISSLQPEDFATYYCQQSYDTPLTFGGGTKVEIK

SEQ ID NO: 1212 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYENPLTFGGGTKVEIK

SEQ ID NO: 1213 - protein, 107 aa, Artificial Sequence
  synthetic polypeptide
DIQMTQSPSSLSASVGDRVTITCRASQSIITYLNWYQQKPGKAPKLVIYAATSRASGVPSRFSGSGSGTDFTLTISSLQPEDFATYYCQQSYNSPLTFGGGTKVEIK

SEQ ID NO: 1214 - protein, 107 aa, Artificial Sequence
  synthetic polypeptide
DIQMTQSPSSLSASVGDRVTITCRASQSISTYVNWYQQKPGKAPKLLIYAATSRHSGVPSRFSGSGSGTDFTLTISSLQPEDFATYYCQQSYENPLTFGGGTKVEIK

SEQ ID NO: 1215 - protein, 107 aa, Artificial Sequence [sequence omitted]

SEQ ID NO: 1216 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYNSPLTFGGGTKVEIK

SEQ ID NO: 1217 - protein, 107 aa, Artificial Sequence
  synthetic polypeptide
DIQMTQSPSSLSASVGDRVTITCRASQSISSYLNWYQQKPGKAPKLVIYAVTSRASGVPSRFSGSGSGTDFTLTISSLQPEDFATYYCQQSYELPLTFGGGTKVEIK

SEQ ID NO: 1218 - protein, 107 aa, Artificial Sequence
  synthetic polypeptide
DIQMTQSPSSLSASVGDRVTITCRASQSIVSYLNWYQQKPGKAPKLVIYATTSRASGVPSRFSGSGSGTDFTLTISSLQPEDFATYYCQQSYNSPLTFGGGTKVEIK

SEQ ID NO: 1219 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYSSPLTFGGGTKVEIK

SEQ ID NO: 1220 - protein, 107 aa, Artificial Sequence
  synthetic polypeptide
DIQMTQSPSSLSASVGDRVTITCRASQSIVTYLNWYQQKPGKAPKLLIYAATSRHSGVPSRFSGSGSGTDFTLTISSLQPEDFATYYCQQSYSNPLTFGGGTKVEIK

SEQ ID NO: 1221 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSYDNPLTFGGGTKVEIK

SEQ ID NO: 1222 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYNTPLTFGGGTKVEIK

SEQ ID NO: 1223 - protein, 107 aa, Artificial Sequence; identical to SEQ ID NO: 1219
  synthetic polypeptide

SEQ ID NO: 1224 - protein, 107 aa, Artificial Sequence
  synthetic polypeptide
DIQMTQSPSSLSASVGDRVTITCRASQSILTYVNWYQQKPGKAPKLLIYATTSRHSGVPSRFSGSGSGTDFTLTISSLQPEDFATYYCQQSYDSPLTFGGGTKVEIK

SEQ ID NO: 1225 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYDTPLTFGGGTKVEIK

SEQ ID NO: 1226 - protein, 107 aa, Artificial Sequence
  synthetic polypeptide
DIQMTQSPSSLSASVGDRVTITCRASQSILTYLNWYQQKPGKAPKLLIYAVTSRASGVPSRFSGSGSGTDFTLTISSLQPEDFATYYCQQSYDSPLTFGGGTKVEIK

SEQ ID NO: 1227 - protein, 107 aa, Artificial Sequence
  synthetic polypeptide
DIQMTQSPSSLSASVGDRVTITCRASQSIITYVNWYQQKPGKAPKLLIYAATSLASGVPSRFSGSGSGTDFTLTISSLQPEDFATYYCQQSYDLPLTFGGGTKVEIK

SEQ ID NO: 1228 - protein, 107 aa, Artificial Sequence
  synthetic polypeptide
DIQMTQSPSSLSASVGDRVTITCRASQSILSYLNWYQQKPGKAPKLLIYAATSLHSGVPSRFSGSGSGTDFTLTISSLQPEDFATYYCQQSYNNPLTFGGGTKVEIK

SEQ ID NO: 1229 - protein, 107 aa, Artificial Sequence
  synthetic polypeptide
DIQMTQSPSSLSASVGDRVTITCRASQSISSYVNWYQQKPGKAPKLVIYAATSRASGVPSRFSGSGSGTDFTLTISSLQPEDFATYYCQQSYSTPLTFGGGTKVEIK

SEQ ID NO: 1230 - protein, 107 aa, Artificial Sequence; identical to SEQ ID NO: 100
  synthetic polypeptide

SEQ ID NO: 1231 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSYDTPLTFGGGTKVEIK

SEQ ID NO: 1232 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYNLPLTFGGGTKVEIK

SEQ ID NO: 1233 - protein, 107 aa, Artificial Sequence
  synthetic polypeptide
DIQMTQSPSSLSASVGDRVTITCRASQSIVSYVNWYQQKPGKAPKLLIYAVTSRASGVPSRFSGSGSGTDFTLTISSLQPEDFATYYCQQSYETPLTFGGGTKVEIK

SEQ ID NO: 1234 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYDTPLTFGGGTKVEIK

SEQ ID NO: 1235 - protein, 107 aa, Artificial Sequence
  synthetic polypeptide
DIQMTQSPSSLSASVGDRVTITCRASQSISTYLNWYQQKPGKAPKLVIYAATSLASGVPSRFSGSGSGTDFTLTISSLQPEDFATYYCQQSYNSPLTFGGGTKVEIK

SEQ ID NO: 1236 - protein, 107 aa, Artificial Sequence
  synthetic polypeptide
DIQMTQSPSSLSASVGDRVTITCRASQSILSYLNWYQQKPGKAPKLVIYAATSRHSGVPSRFSGSGSGTDFTLTISSLQPEDFATYYCQQSDDLPLTFGGGTKVEIK

SEQ ID NO: 1237 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYESPLTFGGGTKVEIK

SEQ ID NO: 1238 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYDSPLTFGGGTKVEIK

SEQ ID NO: 1239 - protein, 107 aa, Artificial Sequence
  synthetic polypeptide
DIQMTQSPSSLSASVGDRVTITCRASQSIISYLNWYQQKPGKAPKLLIYAASSLQSGVPSRFSGSGSGTDFTLTISSLQPEDFATYYCQQSYSTPLTFGGGTKVEIK

SEQ ID NO: 1240 - protein, 107 aa, Artificial Sequence
  synthetic polypeptide
DIQMTQSPSSLSASVGDRVTITCRASQSISSYLNWYQQKPGKAPKLVIYAATSRASGVPSRFSGSGSGTDFTLTISSLQPEDFATYYCQQSYDLPLTFGGGTKVEIK

SEQ ID NO: 1241 - protein, 107 aa, Artificial Sequence; identical to SEQ ID NO: 91
  synthetic polypeptide

SEQ ID NO: 1242 - protein, 107 aa, Artificial Sequence [sequence omitted]

SEQ ID NO: 1243 - protein, 107 aa, Artificial Sequence; identical to SEQ ID NO: 1227
  synthetic polypeptide

SEQ ID NO: 1244 - protein, 107 aa, Artificial Sequence
  synthetic polypeptide
DIQMTQSPSSLSASVGDRVTITCRASQSIISYLNWYQQKPGKAPKLLIYAVTSRASGVPSRFSGSGSGTDFTLTISSLQPEDFATYYCQQSYENPLTFGGGTKVEIK

SEQ ID NO: 1245 - protein, 107 aa, Artificial Sequence
  synthetic polypeptide
DIQMTQSPSSLSASVGDRVTITCRASQSILTYLNWYQQKPGKAPKLVIYAVTSRASGVPSRFSGSGSGTDFTLTISSLQPEDFATYYCQQSYELPLTFGGGTKVEIK

SEQ ID NO: 1246 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYDTPLTFGGGTKVEIK

SEQ ID NO: 1247 - protein, 107 aa, Artificial Sequence
  synthetic polypeptide
DIQMTQSPSSLSASVGDRVTITCRASQSISTYVNWYQQKPGKAPKLLIYAATSLASGVPSRFSGSGSGTDFTLTISSLQPEDFATYYCQQSYSTPLTFGGGTKVEIK

SEQ ID NO: 1248 - protein, 107 aa, Artificial Sequence
  synthetic polypeptide
DIQMTQSPSSLSASVGDRVTITCRASQSILTYVNWYQQKPGKAPKLLIYAASSLQSGVPSRFSGSGSGTDFTLTISSLQPEDFATYYCQQSYSTPLTFGGGTKVEIK

SEQ ID NO: 1249 - protein, 107 aa, Artificial Sequence
  synthetic polypeptide
DIQMTQSPSSLSASVGDRVTITCRASQSIVSYVNWYQQKPGKAPKLVIYAVTSRASGVPSRFSGSGSGTDFTLTISSLQPEDFATYYCQQSYDSPLTFGGGTKVEIK

SEQ ID NO: 1250 - protein, 107 aa, Artificial Sequence
  synthetic polypeptide
DIQMTQSPSSLSASVGDRVTITCRASQSILTYLNWYQQKPGKAPKLLIYAASSLQSGVPSRFSGSGSGTDFTLTISSLQPEDFATYYCQQSYETPLTFGGGTKVEIK

SEQ ID NO: 1251 - protein, 107 aa, Artificial Sequence
  synthetic polypeptide
DIQMTQSPSSLSASVGDRVTITCRASQSIVTYLNWYQQKPGKAPKLVIYAATSRASGVPSRFSGSGSGTDFTLTISSLQPEDFATYYCQQSYESPLTFGGGTKVEIK

SEQ ID NO: 1252 - protein, 107 aa, Artificial Sequence
  synthetic polypeptide
DIQMTQSPSSLSASVGDRVTITCRASQSIVSYVNWYQQKPGKAPKLVIYATTSRASGVPSRFSGSGSGTDFTLTISSLQPEDFATYYCQQSYESPLTFGGGTKVEIK

SEQ ID NO: 1253 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYESPLTFGGGTKVEIK

SEQ ID NO: 1254 - protein, 107 aa, Artificial Sequence
  synthetic polypeptide
DIQMTQSPSSLSASVGDRVTITCRASQSIISYLNWYQQKPGKAPKLLIYAATSLASGVPSRFSGSGSGTDFTLTISSLQPEDFATYYCQQSYDTPLTFGGGTKVEIK

SEQ ID NO: 1255 - protein, 107 aa, Artificial Sequence
  synthetic polypeptide
DIQMTQSPSSLSASVGDRVTITCRASQSISSYVNWYQQKPGKAPKLVIYATTSRHSGVPSRFSGSGSGTDFTLTISSLQPEDFATYYCQQSYNSPLTFGGGTKVEIK

SEQ ID NO: 1256 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYENPLTFGGGTKVEIK

SEQ ID NO: 1257 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYDLPLTFGGGTKVEIK

SEQ ID NO: 1258 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYDSPLTFGGGTKVEIK

SEQ ID NO: 1259 - protein, 107 aa, Artificial Sequence
  synthetic polypeptide
DIQMTQSPSSLSASVGDRVTITCRASQSIISYLNWYQQKPGKAPKLVIYAATSRHSGVPSRFSGSGSGTDFTLTISSLQPEDFATYYCQQSYDSPLTFGGGTKVEIK

SEQ ID NO: 1260 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSYDLPLTFGGGTKVEIK

SEQ ID NO: 1261 - protein, 107 aa, Artificial Sequence
  synthetic polypeptide
DIQMTQSPSSLSASVGDRVTITCRASQSILTYLNWYQQKPGKAPKLLIYAASSLQSGVPSRFSGSGSGTDFTLTISSLQPEDFATYYCQQSYSTPLTFGGGTKVEIK

SEQ ID NO: 1262 - protein, 107 aa, Artificial Sequence
  synthetic polypeptide
DIQMTQSPSSLSASVGDRVTITCRASQSIVTYLNWYQQKPGKAPKLVIYAATSRASGVPSRFSGSGSGTDFTLTISSLQPEDFATYYCQQSYDSPLTFGGGTKVEIK

SEQ ID NO: 1263 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYNNPLTFGGGTKVEIK

SEQ ID NO: 1264 - protein, 107 aa, Artificial Sequence
  synthetic polypeptide
DIQMTQSPSSLSASVGDRVTITCRASQSILSYLNWYQQKPGKAPKLVIYAATSRHSGVPSRFSGSGSGTDFTLTISSLQPEDFATYYCQQGYDLPLTFGGGTKVEIK

SEQ ID NO: 1265 - protein, 107 aa, Artificial Sequence
  synthetic polypeptide
DIQMTQSPSSLSASVGDRVTITCRASQSILSYVNWYQQKPGKAPKLVIYATTSRASGVPSRFSGSGSGTDFTLTISSLQPEDFATYYCQQSYETPLTFGGGTKVEIK

SEQ ID NO: 1266 - protein, 107 aa, Artificial Sequence; identical to SEQ ID NO: 1222
  synthetic polypeptide

SEQ ID NO: 1267 - protein, 107 aa, Artificial Sequence
  synthetic polypeptide
DIQMTQSPSSLSASVGDRVTITCRASQSIITYLNWYQQKPGKAPKLVIYAATSRHSGVPSRFSGSGSGTDFTLTISSLQPEDFATYYCQQSYDTPLTFGGGTKVEIK

SEQ ID NO: 1268 - protein, 107 aa, Artificial Sequence; identical to SEQ ID NO: 573
  synthetic polypeptide

SEQ ID NO: 1269 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYESPLTFGGGTKVEIK

SEQ ID NO: 1270 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSDSSPLTFGGGTKVEIK

SEQ ID NO: 1271 - protein, 107 aa, Artificial Sequence; identical to SEQ ID NO: 551
  synthetic polypeptide

SEQ ID NO: 1272 - protein, 107 aa, Artificial Sequence
  synthetic polypeptide
DIQMTQSPSSLSASVGDRVTITCRASQSILSYVNWYQQKPGKAPKLLIYATTSRASGVPSRFSGSGSGTDFTLTISSLQPEDFATYYCQQSYDNPLTFGGGTKVEIK

SEQ ID NO: 1273 - protein, 107 aa, Artificial Sequence
  synthetic polypeptide
DIQMTQSPSSLSASVGDRVTITCRASQSILSYLNWYQQKPGKAPKLVIYAVTSRHSGVPSRFSGSGSGTDFTLTISSLQPEDFATYYCQQSYDSPLTFGGGTKVEIK

SEQ ID NO: 1274 - protein, 107 aa, Artificial Sequence
  synthetic polypeptide
DIQMTQSPSSLSASVGDRVTITCRASQSILSYVNWYQQKPGKAPKLVIYATTSLASGVPSRFSGSGSGTDFTLTISSLQPEDFATYYCQQSYDTPLTFGGGTKVEIK

SEQ ID NO: 1275 - protein, 107 aa, Artificial Sequence
  synthetic polypeptide
DIQMTQSPSSLSASVGDRVTITCRASQSIVTYLNWYQQKPGKAPKLVIYAATSRHSGVPSRFSGSGSGTDFTLTISSLQPEDFATYYCQQSYNNPLTFGGGTKVEIK

SEQ ID NO: 1276 - protein, 107 aa, Artificial Sequence
  synthetic polypeptide
DIQMTQSPSSLSASVGDRVTITCRASQSIVSYLNWYQQKPGKAPKLLIYAATSRHSGVPSRFSGSGSGTDFTLTISSLQPEDFATYYCQQSYDNPLTFGGGTKVEIK

SEQ ID NO: 1277 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYSTPLTFGGGTKVEIK

SEQ ID NO: 1278 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYDSPLTFGGGTKVEIK

SEQ ID NO: 1279 - protein, 107 aa, Artificial Sequence; identical to SEQ ID NO: 89
  synthetic polypeptide

SEQ ID NO: 1280 - protein, 107 aa, Artificial Sequence
  synthetic polypeptide
DIQMTQSPSSLSASVGDRVTITCRASQSIVTYLNWYQQKPGKAPKLLIYAATSRASGVPSRFSGSGSGTDFTLTISSLQPEDFATYYCQQSYDSPLTFGGGTKVEIK

SEQ ID NO: 1281 - protein, 107 aa, Artificial Sequence
  synthetic polypeptide
DIQMTQSPSSLSASVGDRVTITCRASQSIVSYVNWYQQKPGKAPKLLIYAATSLASGVPSRFSGSGSGTDFTLTISSLQPEDFATYYCQQSYENPLTFGGGTKVEIK

SEQ ID NO: 1282 - protein, 107 aa, Artificial Sequence
  synthetic polypeptide
DIQMTQSPSSLSASVGDRVTITCRASQSISTYLNWYQQKPGKAPKLLIYAVTSLHSGVPSRFSGSGSGTDFTLTISSLQPEDFATYYCQQSYESPLTFGGGTKVEIK

SEQ ID NO: 1283 - protein, 107 aa, Artificial Sequence; identical to SEQ ID NO: 589
  synthetic polypeptide

SEQ ID NO: 1284 - protein, 107 aa, Artificial Sequence
  synthetic polypeptide
DIQMTQSPSSLSASVGDRVTITCRASQSISTYLNWYQQKPGKAPKLLIYAVTSRASGVPSRFSGSGSGTDFTLTISSLQPEDFATYYCQQSYNSPLTFGGGTKVEIK

SEQ ID NO: 1285 - protein, 107 aa, Artificial Sequence
  synthetic polypeptide
DIQMTQSPSSLSASVGDRVTITCRASQSISSYLNWYQQKPGKAPKLVIYAVTSRASGVPSRFSGSGSGTDFTLTISSLQPEDFATYYCQQSYESPLTFGGGTKVEIK

SEQ ID NO: 1286 - protein, 107 aa, Artificial Sequence
  synthetic polypeptide
DIQMTQSPSSLSASVGDRVTITCRASQSIISYVNWYQQKPGKAPKLLIYAVTSRASGVPSRFSGSGSGTDFTLTISSLQPEDFATYYCQQSYDLPLTFGGGTKVEIK

SEQ ID NO: 1287 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYDLPLTFGGGTKVEIK

SEQ ID NO: 1288 - protein, 107 aa, Artificial Sequence
  synthetic polypeptide
DIQMTQSPSSLSASVGDRVTITCRASQSILSYLNWYQQKPGKAPKLLIYAATSLHSGVPSRFSGSGSGTDFTLTISSLQPEDFATYYCQQSYESPLTFGGGTKVEIK

SEQ ID NO: 1289 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSDSTPLTFGGGTKVEIK

SEQ ID NO: 1290 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYDSPLTFGGGTKVEIK

SEQ ID NO: 1291 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYNSPLTFGGGTKVEIK

SEQ ID NO: 1292 - protein, 107 aa, Artificial Sequence
  synthetic polypeptide
DIQMTQSPSSLSASVGDRVTITCRASQSIISYLNWYQQKPGKAPKLLIYAATSLASGVPSRFSGSGSGTDFTLTISSLQPEDFATYYCQQSYSLPLTFGGGTKVEIK

SEQ ID NO: 1293 - protein, 107 aa, Artificial Sequence; identical to SEQ ID NO: 62
  synthetic polypeptide

SEQ ID NO: 1294 - protein, 107 aa, Artificial Sequence
  synthetic polypeptide
DIQMTQSPSSLSASVGDRVTITCRASQSIISYVNWYQQKPGKAPKLVIYAVTSRASGVPSRFSGSGSGTDFTLTISSLQPEDFATYYCQQSYDTPLTFGGGTKVEIK

SEQ ID NO: 1295 - protein, 107 aa, Artificial Sequence
  synthetic polypeptide
DIQMTQSPSSLSASVGDRVTITCRASQSISTYLNWYQQKPGKAPKLLIYAATSRHSGVPSRFSGSGSGTDFTLTISSLQPEDFATYYCQQSYENPLTFGGGTKVEIK

SEQ ID NO: 1296 - protein, 107 aa, Artificial Sequence
  synthetic polypeptide
DIQMTQSPSSLSASVGDRVTITCRASQSILSYVNWYQQKPGKAPKLLIYAVTSLASGVPSRFSGSGSGTDFTLTISSLQPEDFATYYCQQSYETPLTFGGGTKVEIK

SEQ ID NO: 1297 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYSSPLTFGGGTKVEIK

SEQ ID NO: 1298 - protein, 107 aa, Artificial Sequence
  synthetic polypeptide
DIQMTQSPSSLSASVGDRVTITCRASQSILSYVNWYQQKPGKAPKLVIYAVTSRHSGVPSRFSGSGSGTDFTLTISSLQPEDFATYYCQQSYDSPLTFGGGTKVEIK

SEQ ID NO: 1299 - protein, 107 aa, Artificial Sequence
  synthetic polypeptide
DIQMTQSPSSLSASVGDRVTITCRASQSIVSYLNWYQQKPGKAPKLVIYAATSRHSGVPSRFSGSGSGTDFTLTISSLQPEDFATYYCQQSYDSPLTFGGGTKVEIK

SEQ ID NO: 1300 - protein, 107 aa, Artificial Sequence; identical to SEQ ID NO: 537
  synthetic polypeptide

SEQ ID NO: 1301 - protein, 107 aa, Artificial Sequence
  synthetic polypeptide
DIQMTQSPSSLSASVGDRVTITCRASQSIVTYLNWYQQKPGKAPKLVIYATTSRASGVPSRFSGSGSGTDFTLTISSLQPEDFATYYCQQSYNLPLTFGGGTKVEIK

SEQ ID NO: 1302 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYDNPLTFGGGTKVEIK

SEQ ID NO: 1303 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYESPLTFGGGTKVEIK

SEQ ID NO: 1304 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYDTPLTFGGGTKVEIK

SEQ ID NO: 1305 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYDLPLTFGGGTKVEIK

SEQ ID NO: 1306 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYDTPLTFGGGTKVEIK

SEQ ID NO: 1307 - protein, 107 aa, Artificial Sequence
  synthetic polypeptide
DIQMTQSPSSLSASVGDRVTITCRASQSIVTYLNWYQQKPGKAPKLVIYAATSRASGVPSRFSGSGSGTDFTLTISSLQPEDFATYYCQQSYSNPLTFGGGTKVEIK

SEQ ID NO: 1308 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYELPLTFGGGTKVEIK

SEQ ID NO: 1309 - protein, 107 aa, Artificial Sequence; identical to SEQ ID NO: 1262
  synthetic polypeptide

SEQ ID NO: 1310 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYETPLTFGGGTKVEIK

SEQ ID NO: 1311 - protein, 107 aa, Artificial Sequence; identical to SEQ ID NO: 584
  synthetic polypeptide

SEQ ID NO: 1312 - protein, 107 aa, Artificial Sequence
  synthetic polypeptide
DIQMTQSPSSLSASVGDRVTITCRASQSIVSYLNWYQQKPGKAPKLLIYAATSLASGVPSRFSGSGSGTDFTLTISSLQPEDFATYYCQQSYDTPLTFGGGTKVEIK

SEQ ID NO: 1313 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYSLPLTFGGGTKVEIK

SEQ ID NO: 1314 - protein, 107 aa, Artificial Sequence
  synthetic polypeptide
DIQMTQSPSSLSASVGDRVTITCRASQSILTYVNWYQQKPGKAPKLVIYAATSRHSGVPSRFSGSGSGTDFTLTISSLQPEDFATYYCQQSYETPLTFGGGTKVEIK

SEQ ID NO: 1315 - protein, 107 aa, Artificial Sequence; identical to SEQ ID NO: 547
  synthetic polypeptide

SEQ ID NO: 1316 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYNLPLTFGGGTKVEIK

SEQ ID NO: 1317 - protein, 107 aa, Artificial Sequence
  synthetic polypeptide
DIQMTQSPSSLSASVGDRVTITCRASQSISTYLNWYQQKPGKAPKLVIYAATSRASGVPSRFSGSGSGTDFTLTISSLQPEDFATYYCQQSYETPLTFGGGTKVEIK

SEQ ID NO: 1318 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYDSPLTFGGGTKVEIK

SEQ ID NO: 1319 - protein, 107 aa, Artificial Sequence
  synthetic polypeptide
DIQMTQSPSSLSASVGDRVTITCRASQSILSYLNWYQQKPGKAPKLLIYATTSRASGVPSRFSGSGSGTDFTLTISSLQPEDFATYYCQQSYENPLTFGGGTKVEIK

SEQ ID NO: 1320 - protein, 107 aa, Artificial Sequence
  synthetic polypeptide
DIQMTQSPSSLSASVGDRVTITCRASQSIVTYLNWYQQKPGKAPKLLIYAASSLQSGVPSRFSGSGSGTDFTLTISSLQPEDFATYYCQQSYDSPLTFGGGTKVEIK

SEQ ID NO: 1321 - protein, 107 aa, Artificial Sequence
  synthetic polypeptide
DIQMTQSPSSLSASVGDRVTITCRASQSIITYLNWYQQKPGKAPKLVIYAATSRASGVPSRFSGSGSGTDFTLTISSLQPEDFATYYCQQSDDSPLTFGGGTKVEIK

SEQ ID NO: 1322 - protein, 107 aa, Artificial Sequence; identical to SEQ ID NO: 91
  synthetic polypeptide

SEQ ID NO: 1323 - protein, 107 aa, Artificial Sequence
  synthetic polypeptide
DIQMTQSPSSLSASVGDRVTITCRASQSILTYVNWYQQKPGKAPKLLIYAATSLASGVPSRFSGSGSGTDFTLTISSLQPEDFATYYCQQSYDSPLTFGGGTKVEIK

SEQ ID NO: 1324 - protein, 107 aa, Artificial Sequence; identical to SEQ ID NO: 81
  synthetic polypeptide

SEQ ID NO: 1325 - protein, 107 aa, Artificial Sequence
  synthetic polypeptide
DIQMTQSPSSLSASVGDRVTITCRASQSIVSYLNWYQQKPGKAPKLLIYAATSRHSGVPSRFSGSGSGTDFTLTISSLQPEDFATYYCQQSYESPLTFGGGTKVEIK

SEQ ID NO: 1326 - protein, 107 aa, Artificial Sequence
  synthetic polypeptide
DIQMTQSPSSLSASVGDRVTITCRASQSIVSYVNWYQQKPGKAPKLLIYAATSRHSGVPSRFSGSGSGTDFTLTISSLQPEDFATYYCQQSYELPLTFGGGTKVEIK

SEQ ID NO: 1327 - protein, 107 aa, Artificial Sequence; identical to SEQ ID NO: 103
  synthetic polypeptide

SEQ ID NO: 1328 - protein, 107 aa, Artificial Sequence; identical to SEQ ID NO: 1207
  synthetic polypeptide

SEQ ID NO: 1329 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYELPLTFGGGTKVEIK

SEQ ID NO: 1330 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSDNSPLTFGGGTKVEIK

SEQ ID NO: 1331 - protein, 107 aa, Artificial Sequence
  synthetic polypeptide
DIQMTQSPSSLSASVGDRVTITCRASQSIVTYLNWYQQKPGKAPKLLIYAATSRASGVPSRFSGSGSGTDFTLTISSLQPEDFATYYCQQSYDTPLTFGGGTKVEIK

SEQ ID NO: 1332 - protein, 107 aa, Artificial Sequence; identical to SEQ ID NO: 547
  synthetic polypeptide

SEQ ID NO: 1333 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYDSPLTFGGGTKVEIK

SEQ ID NO: 1334 - protein, 107 aa, Artificial Sequence
  synthetic polypeptide
DIQMTQSPSSLSASVGDRVTITCRASQSIVSYLNWYQQKPGKAPKLVIYAATSLASGVPSRFSGSGSGTDFTLTISSLQPEDFATYYCQQSYNSPLTFGGGTKVEIK

SEQ ID NO: 1335 - protein, 107 aa, Artificial Sequence; identical to SEQ ID NO: 584
  synthetic polypeptide

SEQ ID NO: 1336 - protein, 107 aa, Artificial Sequence; identical to SEQ ID NO: 1238
  synthetic polypeptide

SEQ ID NO: 1337 - protein, 107 aa, Artificial Sequence; identical to SEQ ID NO: 1302
  synthetic polypeptide

SEQ ID NO: 1338 - protein, 107 aa, Artificial Sequence
  synthetic polypeptide
DIQMTQSPSSLSASVGDRVTITCRASQSIISYVNWYQQKPGKAPKLVIYAATSLHSGVPSRFSGSGSGTDFTLTISSLQPEDFATYYCQQSYSTPLTFGGGTKVEIK

SEQ ID NO: 1339 - protein, 107 aa, Artificial Sequence
  synthetic polypeptide
DIQMTQSPSSLSASVGDRVTITCRASQSILSYLNWYQQKPGKAPKLVIYAVTSLASGVPSRFSGSGSGTDFTLTISSLQPEDFATYYCQQSYESPLTFGGGTKVEIK

SEQ ID NO: 1340 - protein, 107 aa, Artificial Sequence
  synthetic polypeptide
DIQMTQSPSSLSASVGDRVTITCRASQSILTYVNWYQQKPGKAPKLVIYAVTSRASGVPSRFSGSGSGTDFTLTISSLQPEDFATYYCQQSYDTPLTFGGGTKVEIK

SEQ ID NO: 1341 - protein, 107 aa, Artificial Sequence
  synthetic polypeptide
DIQMTQSPSSLSASVGDRVTITCRASQSISSYLNWYQQKPGKAPKLVIYAATSRASGVPSRFSGSGSGTDFTLTISSLQPEDFATYYCQQSDDTPLTFGGGTKVEIK

SEQ ID NO: 1342 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYDSPLTFGGGTKVEIK

SEQ ID NO: 1343 - protein, 107 aa, Artificial Sequence
  synthetic polypeptide
DIQMTQSPSSLSASVGDRVTITCRASQSIVRYLNWYQQKPGKAPKLVIYAATSLASGVPSRFSGSGSGTDFTLTISSLQPEDFATYYCQQSYELPLTFGGGTKVEIK

SEQ ID NO: 1344 - protein, 107 aa, Artificial Sequence
  synthetic polypeptide
DIQMTQSPSSLSASVGDRVTITCRASQSIVSYLNWYQQKPGKAPKLVIYAVTSRASGVPSRFSGSGSGTDFTLTISSLQPEDFATYYCQQSYDSPLTFGGGTKVEIK

SEQ ID NO: 1345 - protein, 107 aa, Artificial Sequence
  synthetic polypeptide
DIQMTQSPSSLSASVGDRVTITCRASQSIISYVNWYQQKPGKAPKLVIYAATSLASGVPSRFSGSGSGTDFTLTISSLQPEDFATYYCQQSYDSPLTFGGGTKVEIK

SEQ ID NO: 1346 - protein, 107 aa, Artificial Sequence; identical to SEQ ID NO: 1212
  synthetic polypeptide

SEQ ID NO: 1347 - protein, 107 aa, Artificial Sequence
  synthetic polypeptide
DIQMTQSPSSLSASVGDRVTITCRASQSIISYVNWYQQKPGKAPKLVIYAATSLHSGVPSRFSGSGSGTDFTLTISSLQPEDFATYYCQQSYSNPLTFGGGTKVEIK

SEQ ID NO: 1348 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYNTPLTFGGGTKVEIK

SEQ ID NO: 1349 - protein, 107 aa, Artificial Sequence; identical to SEQ ID NO: 547
  synthetic polypeptide

SEQ ID NO: 1350 - protein, 107 aa, Artificial Sequence
  synthetic polypeptide
DIQMTQSPSSLSASVGDRVTITCRASQSIVTYLNWYQQKPGKAPKLLIYAATSRASGVPSRFSGSGSGTDFTLTISSLQPEDFATYYCQQSYESPLTFGGGTKVEIK

SEQ ID NO: 1351 - protein, 107 aa, Artificial Sequence
  synthetic polypeptide
DIQMTQSPSSLSASVGDRVTITCRASQSILSYLNWYQQKPGKAPKLVIYAVTSRASGVPSRFSGSGSGTDFTLTISSLQPEDFATYYCQQSYETPLTFGGGTKVEIK

SEQ ID NO: 1352 - protein, 107 aa, Artificial Sequence; identical to SEQ ID NO: 1331
  synthetic polypeptide

SEQ ID NO: 1353 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYESPLTFGGGTKVEIK

SEQ ID NO: 1354 - protein, 107 aa, Artificial Sequence; identical to SEQ ID NO: 1310
  synthetic polypeptide

SEQ ID NO: 1355 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSDDSPLTFGGGTKVEIK

SEQ ID NO: 1356 - protein, 107 aa, Artificial Sequence; identical to SEQ ID NO: 1219
  synthetic polypeptide

SEQ ID NO: 1357 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSYDNPLTFGGGTKVEIK

SEQ ID NO: 1358 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYSSPLTFGGGTKVEIK

SEQ ID NO: 1359 - protein, 107 aa, Artificial Sequence; identical to SEQ ID NO: 91
  synthetic polypeptide

SEQ ID NO: 1360 - protein, 107 aa, Artificial Sequence; identical to SEQ ID NO: 1302
  synthetic polypeptide

SEQ ID NO: 1361 - protein, 107 aa, Artificial Sequence; identical to SEQ ID NO: 1278
  synthetic polypeptide

SEQ ID NO: 1362 - protein, 107 aa, Artificial Sequence; identical to SEQ ID NO: 1278
  synthetic polypeptide

SEQ ID NO: 1363 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYDNPLTFGGGTKVEIK

SEQ ID NO: 1364 - protein, 107 aa, Artificial Sequence
  synthetic polypeptide
DIQMTQSPSSLSASVGDRVTITCRASQSIVSYVNWYQQKPGKAPKLLIYAATSLASGVPSRFSGSGSGTDFTLTISSLQPEDFATYYCQQSYDSPLTFGGGTKVEIK

SEQ ID NO: 1365 - protein, 107 aa, Artificial Sequence
  synthetic polypeptide
DIQMTQSPSSLSASVGDRVTITCRASQSIVSYLNWYQQKPGKAPKLLIYAVTSRASGVPSRFSGSGSGTDFTLTISSLQPEDFATYYCQQSYDSPLTFGGGTKVEIK

SEQ ID NO: 1366 - protein, 107 aa, Artificial Sequence; identical to SEQ ID NO: 586
  synthetic polypeptide

SEQ ID NO: 1367 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSYSSPLTFGGGTKVEIK

SEQ ID NO: 1368 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYSTPLTFGGGTKVEIK

SEQ ID NO: 1369 - protein, 107 aa, Artificial Sequence; identical to SEQ ID NO: 1298
  synthetic polypeptide

SEQ ID NO: 1370 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYSTPLTFGGGTKVEIK

SEQ ID NO: 1371 - protein, 107 aa, Artificial Sequence
  synthetic polypeptide
DIQMTQSPSSLSASVGDRVTITCRASQSILSYVNWYQQKPGKAPKLLIYAVTSRHSGVPSRFSGSGSGTDFTLTISSLQPEDFATYYCQQSYDNPLTFGGGTKVEIK

SEQ ID NO: 1372 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSYSTPLTFGGGTKVEIK

SEQ ID NO: 1373 - protein, 107 aa, Artificial Sequence [sequence omitted]

SEQ ID NO: 1374 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSDNTPLTFGGGTKVEIK

SEQ ID NO: 1375 - protein, 107 aa, Artificial Sequence; identical to SEQ ID NO: 1308
  synthetic polypeptide

SEQ ID NO: 1376 - protein, 107 aa, Artificial Sequence [sequence omitted]

SEQ ID NO: 1377 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYETPLTFGGGTKVEIK

SEQ ID NO: 1378 - protein, 107 aa, Artificial Sequence
  synthetic polypeptide
DIQMTQSPSSLSASVGDRVTITCRASQSIISYVNWYQQKPGKAPKLVIYAATSRASGVPSRFSGSGSGTDFTLTISSLQPEDFATYYCQQSYESPLTFGGGTKVEIK

SEQ ID NO: 1379 - protein, 107 aa, Artificial Sequence; identical to SEQ ID NO: 1216
  synthetic polypeptide

SEQ ID NO: 1380 - protein, 107 aa, Artificial Sequence; identical to SEQ ID NO: 566
  synthetic polypeptide

SEQ ID NO: 1381 - protein, 107 aa, Artificial Sequence; identical to SEQ ID NO: 1368
  synthetic polypeptide

SEQ ID NO: 1382 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYDLPLTFGGGTKVEIK

SEQ ID NO: 1383 - protein, 107 aa, Artificial Sequence
  synthetic polypeptide
DIQMTQSPSSLSASVGDRVTITCRASQSISRYLNWYQQKPGKAPKLLIYAVTSLASGVPSRFSGSGSGTDFTLTISSLQPEDFATYYCQQSYESPLTFGGGTKVEIK

SEQ ID NO: 1384 - protein, 120 aa, Artificial Sequence
  synthetic polypeptide
EVQLLESGGGLVQPGGSLRLSCAASGFTFSSYSMNWVRQAPGKGLEWVASINYNGGYKSYADSVKGRFTISRDNSKNTLYLQMNSLRAEDTAVYYCARGATWHDTHLDYWGQGTLVTVSS

SEQ ID NO: 1385 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARGATWHDTHLDYWGQGTLVTVSS

SEQ ID NO: 1386 - protein, 120 aa, Artificial Sequence
  synthetic polypeptide
EVQLLESGGGLVQPGGSLRLSCAASGFTFDSYSMNWVRQAPGKGLEWVSNINYNGGYKGYADSVKGRFTISRDNSKNTLYLQMNSLRAEDTAVYYCARGATWHDTHLDYWGQGTLVTVSS

SEQ ID NO: 1387 - protein, 120 aa, Artificial Sequence
  synthetic polypeptide
EVQLLESGGGLVQPGGSLRLSCAASGFTFDSYSMNWVRQAPGKGLEWVANINYNGGYKGYADSVKGRFTISRDNSKNTLYLQMNSLRAEDTAVYYCARGATWHDTHLDYWGQGTLVTVSS

SEQ ID NO: 1388 - protein, 120 aa, Artificial Sequence
  synthetic polypeptide
EVQLLESGGGLVQPGGSLRLSCAASGFTFSSYSMHWVRQAPGKGLEWVASINYNGGYTSYADSVKGRFTISRDNSKNTLYLQMNSLRAEDTAVYYCARGATWHDTHLDYWGQGTLVTVSS

SEQ ID NO: 1389 - protein, 120 aa, Artificial Sequence
  synthetic polypeptide
EVQLLESGGGLVQPGGSLRLSCAASGFTFSSYGMNWVRQAPGKGLEWVSSINYNSGYKSYADSVKGRFTISRDNSKNTLYLQMNSLRAEDTAVYYCARGATWHDTHLDYWGQGTLVTVSS

SEQ ID NO: 1390 - protein, 120 aa, Artificial Sequence
  synthetic polypeptide
EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARGATWHDTHLDYWGQGTLVTVSS

SEQ ID NO: 1391 - protein, 120 aa, Artificial Sequence
  synthetic polypeptide
EVQLLESGGGLVQPGGSLRLSCAASGFTFDDYSMNWVRQAPGKGLEWVSSINYNGGYKSYADSVKGRFTISRDNSKNTLYLQMNSLRAEDTAVYYCARGATWHDTHLDYWGQGTLVTVSS

SEQ ID NO: 1392 - protein, 120 aa, Artificial Sequence
  synthetic polypeptide
EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARGATWHDTHLDYWGQGTLVTVSS

SEQ ID NO: 1393 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARGATWHDTHLDYWGQGTLVTVSS

SEQ ID NO: 1394 - protein, 120 aa, Artificial Sequence
  synthetic polypeptide
EVQLLESGGGLVQPGGSLRLSCAASGFTFSSYGMHWVRQAPGKGLEWVSNINYNGGYKSYADSVKGRFTISRDNSKNTLYLQMNSLRAEDTAVYYCARGATWHDTHLDYWGQGTLVTVSS

SEQ ID NO: 1395 - protein, 120 aa, Artificial Sequence
  synthetic polypeptide
EVQLLESGGGLVQPGGSLRLSCAASGFTFSSYGMNWVRQAPGKGLEWVSSINYNGGYTSYADSVKGRFTISRDNSKNTLYLQMNSLRAEDTAVYYCARGATWHDTHLDYWGQGTLVTVSS

SEQ ID NO: 1396 - protein, 120 aa, Artificial Sequence
  synthetic polypeptide
EVQLLESGGGLVQPGGSLRLSCAASGFTFDDYSMNWVRQAPGKGLEWVASINYNSGYTGYADSVKGRFTISRDNSKNTLYLQMNSLRAEDTAVYYCARGATWHDTHLDYWGQGTLVTVSS

SEQ ID NO: 1397 - protein, 120 aa, Artificial Sequence
  synthetic polypeptide
EVQLLESGGGLVQPGGSLRLSCAASGFTFDSYGMNWVRQAPGKGLEWVSSINYNSGYKGYADSVKGRFTISRDNSKNTLYLQMNSLRAEDTAVYYCARGATWHDTHLDYWGQGTLVTVSS

SEQ ID NO: 1398 - protein, 120 aa, Artificial Sequence
  synthetic polypeptide
EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARGATWHDTHLDYWGQGTLVTVSS

SEQ ID NO: 1399 - protein, 120 aa, Artificial Sequence
  synthetic polypeptide
EVQLLESGGGLVQPGGSLRLSCAASGFTFDSYSMHWVRQAPGKGLEWVAGINYNGGYTSYADSVKGRFTISRDNSKNTLYLQMNSLRAEDTAVYYCARGATWHDTHLDYWGQGTLVTVSS

SEQ ID NO: 1400 - protein, 120 aa, Artificial Sequence
  synthetic polypeptide
EVQLLESGGGLVQPGGSLRLSCAASGFTFSDYSMNWVRQAPGKGLEWVSSINYNGGYKSYADSVKGRFTISRDNSKNTLYLQMNSLRAEDTAVYYCARGATWHDTHLDYWGQGTLVTVSS

SEQ ID NO: 1401 - protein, 120 aa, Artificial Sequence
  synthetic polypeptide
EVQLLESGGGLVQPGGSLRLSCAASGFTFDSYGMNWVRQAPGKGLEWVASINYNGGYKSYADSVKGRFTISRDNSKNTLYLQMNSLRAEDTAVYYCARGATWHDTHLDYWGQGTLVTVSS

SEQ ID NO: 1402 - protein, 120 aa, Artificial Sequence
  synthetic polypeptide
EVQLLESGGGLVQPGGSLRLSCAASGFTFSDYSMNWVRQAPGKGLEWVSSINYNGGYKGYADSVKGRFTISRDNSKNTLYLQMNSLRAEDTAVYYCARGATWHDTHLDYWGQGTLVTVSS

SEQ ID NO: 1403 - protein, 120 aa, Artificial Sequence; identical to SEQ ID NO: 1385
  synthetic polypeptide

SEQ ID NO: 1404 - protein, 120 aa, Artificial Sequence; identical to SEQ ID NO: 1399
  synthetic polypeptide

SEQ ID NO: 1405 - protein, 120 aa, Artificial Sequence
  synthetic polypeptide
EVQLLESGGGLVQPGGSLRLSCAASGFTFSSYGMHWVRQAPGKGLEWVASINYNSGYKSYADSVKGRFTISRDNSKNTLYLQMNSLRAEDTAVYYCARGATWHDTHLDYWGQGTLVTVSS

SEQ ID NO: 1406 - protein, 120 aa, Artificial Sequence
  synthetic polypeptide
EVQLLESGGGLVQPGGSLRLSCAASGFTFSSYGMNWVRQAPGKGLEWVASINYNGGYTGYADSVKGRFTISRDNSKNTLYLQMNSLRAEDTAVYYCARGATWHDTHLDYWGQGTLVTVSS

SEQ ID NO: 1407 - protein, 120 aa, Artificial Sequence
  synthetic polypeptide
EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARGATWHDTHLDYWGQGTLVTVSS

SEQ ID NO: 1408 - protein, 120 aa, Artificial Sequence
  synthetic polypeptide
EVQLLESGGGLVQPGGSLRLSCAASGFTFSDYSMNWVRQAPGKGLEWVSSINYNSGYKSYADSVKGRFTISRDNSKNTLYLQMNSLRAEDTAVYYCARGATWHDTHLDYWGQGTLVTVSS

SEQ ID NO: 1409 - protein, 120 aa, Artificial Sequence
  synthetic polypeptide
EVQLLESGGGLVQPGGSLRLSCAASGFTFDDYGMNWVRQAPGKGLEWVSNINYNGGYTGYADSVKGRFTISRDNSKNTLYLQMNSLRAEDTAVYYCARGATWHDTHLDYWGQGTLVTVSS

SEQ ID NO: 1410 - protein, 120 aa, Artificial Sequence; identical to SEQ ID NO: 1395
  synthetic polypeptide

SEQ ID NO: 1411 - protein, 120 aa, Artificial Sequence
  synthetic polypeptide
EVQLLESGGGLVQPGGSLRLSCAASGFTFDDYSMHWVRQAPGKGLEWVANINYNSGYTGYADSVKGRFTISRDNSKNTLYLQMNSLRAEDTAVYYCARGATWHDTHLDYWGQGTLVTVSS

SEQ ID NO: 1412 - protein, 120 aa, Artificial Sequence
  synthetic polypeptide
EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARGATWHDTALDYWGQGTLVTVSS

SEQ ID NO: 1413 - protein, 120 aa, Artificial Sequence
  synthetic polypeptide
EVQLLESGGGLVQPGGSLRLSCAASGFTFSSYSMHWVRQAPGKGLEWVSSINYNGGYTSYADSVKGRFTISRDNSKNTLYLQMNSLRAEDTAVYYCARGATWHDTHLDYWGQGTLVTVSS

SEQ ID NO: 1414 - protein, 120 aa, Artificial Sequence
  synthetic polypeptide
EVQLLESGGGLVQPGGSLRLSCAASGFTFDSYGMHWVRQAPGKGLEWVANINYNGGYKSYADSVKGRFTISRDNSKNTLYLQMNSLRAEDTAVYYCARGATWHDTHLDYWGQGTLVTVSS

SEQ ID NO: 1415 - protein, 120 aa, Artificial Sequence
  synthetic polypeptide
EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARGATWHDTHLDYWGQGTLVTVSS

SEQ ID NO: 1416 - protein, 120 aa, Artificial Sequence
  synthetic polypeptide
EVQLLESGGGLVQPGGSLRLSCAASGFTFDSYGMNWVRQAPGKGLEWVANINYNGGYKGYADSVKGRFTISRDNSKNTLYLQMNSLRAEDTAVYYCARGATWHDTHLDYWGQGTLVTVSS

SEQ ID NO: 1417 - protein, 120 aa, Artificial Sequence
  synthetic polypeptide
EVQLLESGGGLVQPGGSLRLSCAASGFTFSSYGMNWVRQAPGKGLEWVANINYNGGYKGYADSVKGRFTISRDNSKNTLYLQMNSLRAEDTAVYYCARGATWHDTHLDYWGQGTLVTVSS

SEQ ID NO: 1418 - protein, 120 aa, Artificial Sequence
  synthetic polypeptide
EVQLLESGGGLVQPGGSLRLSCAASGFTFSDYSMNWVRQAPGKGLEWVASINYNGGYKGYADSVKGRFTISRDNSKNTLYLQMNSLRAEDTAVYYCARGATWHDTHLDYWGQGTLVTVSS

SEQ ID NO: 1419 - protein, 120 aa, Artificial Sequence
  synthetic polypeptide
EVQLLESGGGLVQPGGSLRLSCAASGFTFSDYGMNWVRQAPGKGLEWVANINYNGGYKSYADSVKGRFTISRDNSKNTLYLQMNSLRAEDTAVYYCARGATWHDTHLDYWGQGTLVTVSS

SEQ ID NO: 1420 - protein, 120 aa, Artificial Sequence
  synthetic polypeptide
EVQLLESGGGLVQPGGSLRLSCAASGFTFSSYSMNWVRQAPGKGLEWVASINYNSGYTGYADSVKGRFTISRDNSKNTLYLQMNSLRAEDTAVYYCARGATWHDTHLDYWGQGTLVTVSS

SEQ ID NO: 1421 - protein, 120 aa, Artificial Sequence
  synthetic polypeptide
EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARGATWHDTHLDYWGQGTLVTVSS

SEQ ID NO: 1422 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARGATWHDTHLDYWGQGTLVTVSS

SEQ ID NO: 1423 - protein, 120 aa, Artificial Sequence
  synthetic polypeptide
EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARGATWHDTHLDYWGQGTLVTVSS

SEQ ID NO: 1424 - protein, 120 aa, Artificial Sequence
  synthetic polypeptide
EVQLLESGGGLVQPGGSLRLSCAASGFTFDDYSMNWVRQAPGKGLEWVSNINYNGGYKSYADSVKGRFTISRDNSKNTLYLQMNSLRAEDTAVYYCARGATWHDTHLDYWGQGTLVTVSS

SEQ ID NO: 1425 - protein, 120 aa, Artificial Sequence
  synthetic polypeptide
EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARGATWHDTHLDYWGQGTLVTVSS

SEQ ID NO: 1426 - protein, 120 aa, Artificial Sequence
  synthetic polypeptide
EVQLLESGGGLVQPGGSLRLSCAASGFTFSSYSMNWVRQAPGKGLEWVAGINYNGGYKSYADSVKGRFTISRDNSKNTLYLQMNSLRAEDTAVYYCARGATWHDTHLDYWGQGTLVTVSS

SEQ ID NO: 1427 - protein, 120 aa, Artificial Sequence
  synthetic polypeptide
EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARGATWHDTHLDYWGQGTLVTVSS

SEQ ID NO: 1428 - protein, 120 aa, Artificial Sequence
  synthetic polypeptide
EVQLLESGGGLVQPGGSLRLSCAASGFTFSSYSMNWVRQAPGKGLEWVANINYNGGYKSYADSVKGRFTISRDNSKNTLYLQMNSLRAEDTAVYYCARGATWHDTHLDYWGQGTLVTVSS

SEQ ID NO: 1429 - protein, 120 aa, Artificial Sequence; identical to SEQ ID NO: 1428
  synthetic polypeptide

SEQ ID NO: 1430 - protein, 120 aa, Artificial Sequence
  synthetic polypeptide
EVQLLESGGGLVQPGGSLRLSCAASGFTFDSYSMNWVRQAPGKGLEWVSNINYNSGYKGYADSVKGRFTISRDNSKNTLYLQMNSLRAEDTAVYYCARGATWHDTHLDYWGQGTLVTVSS

SEQ ID NO: 1431 - protein, 120 aa, Artificial Sequence
  synthetic polypeptide
EVQLLESGGGLVQPGGSLRLSCAASGFTFSSYSMNWVRQAPGKGLEWVASINYNGGYTSYADSVKGRFTISRDNSKNTLYLQMNSLRAEDTAVYYCARGATWHDTHLDYWGQGTLVTVSS

SEQ ID NO: 1432 - protein, 120 aa, Artificial Sequence
  synthetic polypeptide
EVQLLESGGGLVQPGGSLRLSCAASGFTFSDYSMNWVRQAPGKGLEWVSGINYNSGYTSYADSVKGRFTISRDNSKNTLYLQMNSLRAEDTAVYYCARGATWHDTHLDYWGQGTLVTVSS

SEQ ID NO: 1433 - protein, 120 aa, Artificial Sequence
  synthetic polypeptide
EVQLLESGGGLVQPGGSLRLSCAASGFTFSSYSMNWVRQAPGKGLEWVANINYNGGYKGYADSVKGRFTISRDNSKNTLYLQMNSLRAEDTAVYYCARGATWHDTHLDYWGQGTLVTVSS

SEQ ID NO: 1434 - protein, 120 aa, Artificial Sequence
  synthetic polypeptide
EVQLLESGGGLVQPGGSLRLSCAASGFTFSSYGMNWVRQAPGKGLEWVSNINYNGGYKGYADSVKGRFTISRDNSKNTLYLQMNSLRAEDTAVYYCARGATWHDTHLDYWGQGTLVTVSS

SEQ ID NO: 1435 - protein, 120 aa, Artificial Sequence
  synthetic polypeptide
EVQLLESGGGLVQPGGSLRLSCAASGFTFSSYGMNWVRQAPGKGLEWVSNINYNGGYTSYADSVKGRFTISRDNSKNTLYLQMNSLRAEDTAVYYCARGATWHDTHLDYWGQGTLVTVSS

SEQ ID NO: 1436 - protein, 120 aa, Artificial Sequence
  synthetic polypeptide
EVQLLESGGGLVQPGGSLRLSCAASGFTFDSYGMNWVRQAPGKGLEWVANINYNGGYTGYADSVKGRFTISRDNSKNTLYLQMNSLRAEDTAVYYCARGATWHDTHLDYWGQGTLVTVSS

SEQ ID NO: 1437 - protein, 120 aa, Artificial Sequence; identical to SEQ ID NO: 1427
  synthetic polypeptide

SEQ ID NO: 1438 - protein, 120 aa, Artificial Sequence
  synthetic polypeptide
EVQLLESGGGLVQPGGSLRLSCAASGFTFSDYSMNWVRQAPGKGLEWVAGINYNGGYTGYADSVKGRFTISRDNSKNTLYLQMNSLRAEDTAVYYCARGATWHDTHLDYWGQGTLVTVSS

SEQ ID NO: 1439 - protein, 120 aa, Artificial Sequence
  synthetic polypeptide
EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARGATWHDTHLDYWGQGTLVTVSS

SEQ ID NO: 1440 - protein, 120 aa, Artificial Sequence
  synthetic polypeptide
EVQLLESGGGLVQPGGSLRLSCAASGFTFDDYSMNWVRQAPGKGLEWVANINYNGGYTGYADSVKGRFTISRDNSKNTLYLQMNSLRAEDTAVYYCARGATWHDTHLDYWGQGTLVTVSS

SEQ ID NO: 1441 - protein, 120 aa, Artificial Sequence
  synthetic polypeptide
EVQLLESGGGLVQPGGSLRLSCAASGFTFDSYSMNWVRQAPGKGLEWVSNINYNSGYTGYADSVKGRFTISRDNSKNTLYLQMNSLRAEDTAVYYCARGATWHDTHLDYWGQGTLVTVSS

SEQ ID NO: 1442 - protein, 120 aa, Artificial Sequence
  synthetic polypeptide
EVQLLESGGGLVQPGGSLRLSCAASGFTFSSYSMNWVRQAPGKGLEWVSSINYNGGYTSYADSVKGRFTISRDNSKNTLYLQMNSLRAEDTAVYYCARGATWHDTHLDYWGQGTLVTVSS

SEQ ID NO: 1443 - protein, 120 aa, Artificial Sequence
  synthetic polypeptide
EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARGATWHDTALDYWGQGTLVTVSS

SEQ ID NO: 1444 - protein, 120 aa, Artificial Sequence; identical to SEQ ID NO: 1423
  synthetic polypeptide

SEQ ID NO: 1445 - protein, 120 aa, Artificial Sequence
  synthetic polypeptide
EVQLLESGGGLVQPGGSLRLSCAASGFTFSSYSMNWVRQAPGKGLEWVSNINYNSGYKSYADSVKGRFTISRDNSKNTLYLQMNSLRAEDTAVYYCARGATWHDTHLDYWGQGTLVTVSS

SEQ ID NO: 1446 - protein, 120 aa, Artificial Sequence; identical to SEQ ID NO: 1432
  synthetic polypeptide

SEQ ID NO: 1447 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARGATWHDTHLDYWGQGTLVTVSS

SEQ ID NO: 1448 - protein, 120 aa, Artificial Sequence
  synthetic polypeptide
EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARGATWHDTHLDYWGQGTLVTVSS

SEQ ID NO: 1449 - protein, 120 aa, Artificial Sequence; identical to SEQ ID NO: 1423
  synthetic polypeptide

SEQ ID NO: 1450 - protein, 120 aa, Artificial Sequence
  synthetic polypeptide
EVQLLESGGGLVQPGGSLRLSCAASGFTFSDYSMNWVRQAPGKGLEWVSNINYNGGYTSYADSVKGRFTISRDNSKNTLYLQMNSLRAEDTAVYYCARGATWHDTHLDYWGQGTLVTVSS

SEQ ID NO: 1451 - protein, 120 aa, Artificial Sequence
  synthetic polypeptide
EVQLLESGGGLVQPGGSLRLSCAASGFTFSSYSMNWVRQAPGKGLEWVSGINYNGGYKGYADSVKGRFTISRDNSKNTLYLQMNSLRAEDTAVYYCARGATWHDTHLDYWGQGTLVTVSS

SEQ ID NO: 1452 - protein, 120 aa, Artificial Sequence
  synthetic polypeptide
EVQLLESGGGLVQPGGSLRLSCAASGFTFSSYSMNWVRQAPGKGLEWVSSINYNSGYTSYADSVKGRFTISRDNSKNTLYLQMNSLRAEDTAVYYCARGATWHDTHLDYWGQGTLVTVSS

SEQ ID NO: 1453 - protein, 120 aa, Artificial Sequence; identical to SEQ ID NO: 1450
  synthetic polypeptide

SEQ ID NO: 1454 - protein, 120 aa, Artificial Sequence; identical to SEQ ID NO: 1385
  synthetic polypeptide

SEQ ID NO: 1455 - protein, 120 aa, Artificial Sequence; identical to SEQ ID NO: 1422
  synthetic polypeptide

SEQ ID NO: 1456 - protein, 120 aa, Artificial Sequence; identical to SEQ ID NO: 1421
  synthetic polypeptide

SEQ ID NO: 1457 - protein, 120 aa, Artificial Sequence
  synthetic polypeptide
EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARGATWHDTHLDYWGQGTLVTVSS

SEQ ID NO: 1458 - protein, 120 aa, Artificial Sequence; identical to SEQ ID NO: 1423
  synthetic polypeptide

SEQ ID NO: 1459 - protein, 120 aa, Artificial Sequence
  synthetic polypeptide
EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARGATWHDTHLDYWGQGTLVTVSS

SEQ ID NO: 1460 - protein, 120 aa, Artificial Sequence; identical to SEQ ID NO: 1448
  synthetic polypeptide

SEQ ID NO: 1461 - protein, 120 aa, Artificial Sequence; identical to SEQ ID NO: 1423
  synthetic polypeptide

SEQ ID NO: 1462 - protein, 120 aa, Artificial Sequence
  synthetic polypeptide
EVQLLESGGGLVQPGGSLRLSCAASGFTFSDYGMNWVRQAPGKGLEWVANINYNGGYKGYADSVKGRFTISRDNSKNTLYLQMNSLRAEDTAVYYCARGATWHDTHLDYWGQGTLVTVSS

SEQ ID NO: 1463 - protein, 120 aa, Artificial Sequence
  synthetic polypeptide
EVQLLESGGGLVQPGGSLRLSCAASGFTFSSYSMNWVRQAPGKGLEWVSSINYNGGYKGYADSVKGRFTISRDNSKNTLYLQMNSLRAEDTAVYYCARGATWHDTHLDYWGQGTLVTVSS

SEQ ID NO: 1464 - protein, 120 aa, Artificial Sequence; identical to SEQ ID NO: 1423
  synthetic polypeptide

SEQ ID NO: 1465 - protein, 120 aa, Artificial Sequence; identical to SEQ ID NO: 1416
  synthetic polypeptide

SEQ ID NO: 1466 - protein, 120 aa, Artificial Sequence
  synthetic polypeptide
EVQLLESGGGLVQPGGSLRLSCAASGFTFSSYSMNWVRQAPGKGLEWVSNINYNSGYKGYADSVKGRFTISRDNSKNTLYLQMNSLRAEDTAVYYCARGATWHDTHLDYWGQGTLVTVSS

SEQ ID NO: 1467 - protein, 120 aa, Artificial Sequence; identical to SEQ ID NO: 1423
  synthetic polypeptide

SEQ ID NO: 1468 - protein, 120 aa, Artificial Sequence
  synthetic polypeptide
EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARGATWHDTHLDYWGQGTLVTVSS

SEQ ID NO: 1469 - protein, 120 aa, Artificial Sequence; identical to SEQ ID NO: 1423
  synthetic polypeptide

SEQ ID NO: 1470 - protein, 120 aa, Artificial Sequence
  synthetic polypeptide
EVQLLESGGGLVQPGGSLRLSCAASGFTFSSYGMNWVRQAPGKGLEWVSSINYNGGYKGYADSVKGRFTISRDNSKNTLYLQMNSLRAEDTAVYYCARGATWHDTHLDYWGQGTLVTVSS

SEQ ID NO: 1471 - protein, 120 aa, Artificial Sequence; identical to SEQ ID NO: 1442
  synthetic polypeptide

SEQ ID NO: 1472 - protein, 120 aa, Artificial Sequence
  synthetic polypeptide
EVQLLESGGGLVQPGGSLRLSCAASGFTFSSYSMNWVRQAPGKGLEWVSGINYNGGYTGYADSVKGRFTISRDNSKNTLYLQMNSLRAEDTAVYYCARGATWHDTHLDYWGQGTLVTVSS

SEQ ID NO: 1473 - protein, 120 aa, Artificial Sequence; identical to SEQ ID NO: 1448
  synthetic polypeptide

SEQ ID NO: 1474 - protein, 120 aa, Artificial Sequence; identical to SEQ ID NO: 1426
  synthetic polypeptide

SEQ ID NO: 1475 - protein, 120 aa, Artificial Sequence
  synthetic polypeptide
EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCARGATWHDTHLDYWGQGTLVTVSS

SEQ ID NO: 1476 - protein, 120 aa, Artificial Sequence; identical to SEQ ID NO: 1421
  synthetic polypeptide

SEQ ID NO: 1477 - protein, 107 aa, Artificial Sequence
  synthetic polypeptide
DIQMTQSPSSLSASVGDRVTITCRASQSIITYLNWYQQKPGKAPKLVIYAATSRASGVPSRFSGSGSGTDFTLTISSLQPEDFATYYCQQSDNTPLTFGGGTKVEIK

SEQ ID NO: 1478 - protein, 107 aa, Artificial Sequence; identical to SEQ ID NO: 70
  synthetic polypeptide

SEQ ID NO: 1479 - protein, 107 aa, Artificial Sequence
  synthetic polypeptide
DIQMTQSPSSLSASVGDRVTITCRASQSISTYLNWYQQKPGKAPKLVIYAATSRHSGVPSRFSGSGSGTDFTLTISSLQPEDFATYYCQQSYENPLTFGGGTKVEIK

SEQ ID NO: 1480 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSYDTPLTFGGGTKVEIK

SEQ ID NO: 1481 - protein, 107 aa, Artificial Sequence
  synthetic polypeptide
DIQMTQSPSSLSASVGDRVTITCRASQSIVTYLNWYQQKPGKAPKLLIYAATSLASGVPSRFSGSGSGTDFTLTISSLQPEDFATYYCQQSYDNPLTFGGGTKVEIK

SEQ ID NO: 1482 - protein, 107 aa, Artificial Sequence [sequence omitted]

SEQ ID NO: 1483 - protein, 107 aa, Artificial Sequence
  synthetic polypeptide
DIQMTQSPSSLSASVGDRVTITCRASQSISTYLNWYQQKPGKAPKLLIYAATSRASGVPSRFSGSGSGTDFTLTISSLQPEDFATYYCQQSYESPLTFGGGTKVEIK

SEQ ID NO: 1484 - protein, 107 aa, Artificial Sequence
  synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYNTPLTFGGGTKVEIK

SEQ ID NO: 1485 - protein, 107 aa, Artificial Sequence
  synthetic polypeptide
DIQMTQSPSSLSASVGDRVTITCRASQSIVTYVNWYQQKPGKAPKLLIYAATSRASGVPSRFSGSGSGTDFTLTISSLQPEDFATYYCQQSYETPLTFGGGTKVEIK

SEQ ID NO: 1486 - protein, 107 aa, Artificial Sequence
  synthetic polypeptide
DIQMTQSPSSLSASVGDRVTITCRASQSILTYVNWYQQKPGKAPKLLIYAATSLHSGVPSRFSGSGSGTDFTLTISSLQPEDFATYYCQQSYSTPLTFGGGTKVEIK

SEQ ID NO: 1487 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSYENPLTFGGGTKVEIK

SEQ ID NO: 1488 - protein, 107 aa, Artificial Sequence [sequence omitted]

SEQ ID NO: 1489 - protein, 107 aa, Artificial Sequence; identical to SEQ ID NO: 583
  synthetic polypeptide

SEQ ID NO: 1490 - protein, 107 aa, Artificial Sequence
  synthetic polypeptide
DIQMTQSPSSLSASVGDRVTITCRASQSIISYLNWYQQKPGKAPKLLIYAVTSRASGVPSRFSGSGSGTDFTLTISSLQPEDFATYYCQQSYDTPLTFGGGTKVEIK

SEQ ID NO: 1491 - protein, 107 aa, Artificial Sequence
  synthetic polypeptide
DIQMTQSPSSLSASVGDRVTITCRASQSIISYVNWYQQKPGKAPKLVIYAATSLHSGVPSRFSGSGSGTDFTLTISSLQPEDFATYYCQQSYNSPLTFGGGTKVEIK

SEQ ID NO: 1492 - protein, 107 aa, Artificial Sequence; identical to SEQ ID NO: 580
  synthetic polypeptide

SEQ ID NO: 1493 - protein, 107 aa, Artificial Sequence; identical to SEQ ID NO: 1345
  synthetic polypeptide

SEQ ID NO: 1494 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYDNPLTFGGGTKVEIK

SEQ ID NO: 1495 - protein, 107 aa, Artificial Sequence; identical to SEQ ID NO: 73
  synthetic polypeptide

SEQ ID NO: 1496 - protein, 107 aa, Artificial Sequence
  synthetic polypeptide
DIQMTQSPSSLSASVGDRVTITCRASQSILTYVNWYQQKPGKAPKLLIYAASSLQSGVPSRFSGSGSGTDFTLTISSLQPEDFATYYCQQSYNSPLTFGGGTKVEIK

SEQ ID NO: 1497 - protein, 107 aa, Artificial Sequence; identical to SEQ ID NO: 580
  synthetic polypeptide

SEQ ID NO: 1498 - protein, 107 aa, Artificial Sequence
  synthetic polypeptide
DIQMTQSPSSLSASVGDRVTITCRASQSILSYVNWYQQKPGKAPKLLIYAASSLQSGVPSRFSGSGSGTDFTLTISSLQPEDFATYYCQQSYSTPLTFGGGTKVEIK

SEQ ID NO: 1499 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYELPLTFGGGTKVEIK

SEQ ID NO: 1500 - protein, 107 aa, Artificial Sequence [sequence omitted]

SEQ ID NO: 1501 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSYDNPLTFGGGTKVEIK

SEQ ID NO: 1502 - protein, 107 aa, Artificial Sequence
  synthetic polypeptide
DIQMTQSPSSLSASVGDRVTITCRASQSISTYLNWYQQKPGKAPKLVIYAATSRHSGVPSRFSGSGSGTDFTLTISSLQPEDFATYYCQQSYDTPLTFGGGTKVEIK

SEQ ID NO: 1503 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYNNPLTFGGGTKVEIK

SEQ ID NO: 1504 - protein, 107 aa, Artificial Sequence
  synthetic polypeptide
DIQMTQSPSSLSASVGDRVTITCRASQSILSYLNWYQQKPGKAPKLVIYATTSRASGVPSRFSGSGSGTDFTLTISSLQPEDFATYYCQQSYENPLTFGGGTKVEIK

SEQ ID NO: 1505 - protein, 107 aa, Artificial Sequence; identical to SEQ ID NO: 569
  synthetic polypeptide

SEQ ID NO: 1506 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYDTPLTFGGGTKVEIK

SEQ ID NO: 1507 - protein, 107 aa, Artificial Sequence
  synthetic polypeptide
DIQMTQSPSSLSASVGDRVTITCRASQSILTYVNWYQQKPGKAPKLLIYATTSRASGVPSRFSGSGSGTDFTLTISSLQPEDFATYYCQQSYDNPLTFGGGTKVEIK

SEQ ID NO: 1508 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSDDTPLTFGGGTKVEIK

SEQ ID NO: 1509 - protein, 107 aa, Artificial Sequence
  synthetic polypeptide
DIQMTQSPSSLSASVGDRVTITCRASQSIITYLNWYQQKPGKAPKLVIYAATSRHSGVPSRFSGSGSGTDFTLTISSLQPEDFATYYCQQSYESPLTFGGGTKVEIK

SEQ ID NO: 1510 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYDTPLTFGGGTKVEIK

SEQ ID NO: 1511 - protein, 107 aa, Artificial Sequence; identical to SEQ ID NO: 547
  synthetic polypeptide

SEQ ID NO: 1512 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYETPLTFGGGTKVEIK

SEQ ID NO: 1513 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYDSPLTFGGGTKVEIK

SEQ ID NO: 1514 - protein, 107 aa, Artificial Sequence
  synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQGYDSPLTFGGGTKVEIK

SEQ ID NO: 1515 - protein, 107 aa, Artificial Sequence; identical to SEQ ID NO: 1513
  synthetic polypeptide

SEQ ID NO: 1516 - protein, 107 aa, Artificial Sequence
  synthetic polypeptide
DIQMTQSPSSLSASVGDRVTITCRASQSIVSYLNWYQQKPGKAPKLLIYAATSRHSGVPSRFSGSGSGTDFTLTISSLQPEDFATYYCQQSYDSPLTFGGGTKVEIK

SEQ ID NO: 1517 - protein, 107 aa, Artificial Sequence; identical to SEQ ID NO: 76
  synthetic polypeptide

SEQ ID NO: 1518 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSYESPLTFGGGTKVEIK

SEQ ID NO: 1519 - protein, 107 aa, Artificial Sequence; identical to SEQ ID NO: 98
  synthetic polypeptide

SEQ ID NO: 1520 - protein, 107 aa, Artificial Sequence; identical to SEQ ID NO: 85
  synthetic polypeptide

SEQ ID NO: 1521 - protein, 107 aa, Artificial Sequence; identical to SEQ ID NO: 1248
  synthetic polypeptide

SEQ ID NO: 1522 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYESPLTFGGGTKVEIK

SEQ ID NO: 1523 - protein, 107 aa, Artificial Sequence
  synthetic polypeptide
DIQMTQSPSSLSASVGDRVTITCRASQSIVSYVNWYQQKPGKAPKLLIYATTSRASGVPSRFSGSGSGTDFTLTISSLQPEDFATYYCQQSYSSPLTFGGGTKVEIK

SEQ ID NO: 1524 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYDLPLTFGGGTKVEIK

SEQ ID NO: 1525 - protein, 107 aa, Artificial Sequence
  synthetic polypeptide
DIQMTQSPSSLSASVGDRVTITCRASQSIVTYLNWYQQKPGKAPKLVIYAATSRASGVPSRFSGSGSGTDFTLTISSLQPEDFATYYCQQSYDTPLTFGGGTKVEIK

SEQ ID NO: 1526 - protein, 107 aa, Artificial Sequence
  synthetic polypeptide
DIQMTQSPSSLSASVGDRVTITCRASQSILTYLNWYQQKPGKAPKLLIYAVTSLHSGVPSRFSGSGSGTDFTLTISSLQPEDFATYYCQQSYETPLTFGGGTKVEIK

SEQ ID NO: 1527 - protein, 107 aa, Artificial Sequence
  synthetic polypeptide
DIQMTQSPSSLSASVGDRVTITCRASQSISTYLNWYQQKPGKAPKLVIYAVTSRASGVPSRFSGSGSGTDFTLTISSLQPEDFATYYCQQSYNSPLTFGGGTKVEIK

SEQ ID NO: 1528 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYDSPLTFGGGTKVEIK

SEQ ID NO: 1529 - protein, 107 aa, Artificial Sequence
  synthetic polypeptide
DIQMTQSPSSLSASVGDRVTITCRASQSILSYLNWYQQKPGKAPKLLIYAVTSRHSGVPSRFSGSGSGTDFTLTISSLQPEDFATYYCQQSYDSPLTFGGGTKVEIK

SEQ ID NO: 1530 - protein, 107 aa, Artificial Sequence; identical to SEQ ID NO: 85
  synthetic polypeptide

SEQ ID NO: 1531 - protein, 107 aa, Artificial Sequence; identical to SEQ ID NO: 1353
  synthetic polypeptide

SEQ ID NO: 1532 - protein, 107 aa, Artificial Sequence; identical to SEQ ID NO: 70
  synthetic polypeptide

SEQ ID NO: 1533 - protein, 107 aa, Artificial Sequence; identical to SEQ ID NO: 1207
  synthetic polypeptide

SEQ ID NO: 1534 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYDLPLTFGGGTKVEIK

SEQ ID NO: 1535 - protein, 107 aa, Artificial Sequence
  synthetic polypeptide
DIQMTQSPSSLSASVGDRVTITCRASQSISSYLNWYQQKPGKAPKLLIYAVTSRASGVPSRFSGSGSGTDFTLTISSLQPEDFATYYCQQSYDLPLTFGGGTKVEIK

SEQ ID NO: 1536 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSYDTPLTFGGGTKVEIK

SEQ ID NO: 1537 - protein, 107 aa, Artificial Sequence
  synthetic polypeptide
DIQMTQSPSSLSASVGDRVTITCRASQSIISYLNWYQQKPGKAPKLVIYAATSRASGVPSRFSGSGSGTDFTLTISSLQPEDFATYYCQQSYSSPLTFGGGTKVEIK

SEQ ID NO: 1538 - protein, 107 aa, Artificial Sequence; identical to SEQ ID NO: 548
  synthetic polypeptide

SEQ ID NO: 1539 - protein, 107 aa, Artificial Sequence; identical to SEQ ID NO: 1291
  synthetic polypeptide

SEQ ID NO: 1540 - protein, 107 aa, Artificial Sequence; identical to SEQ ID NO: 1536
  synthetic polypeptide

SEQ ID NO: 1541 - protein, 107 aa, Artificial Sequence
  synthetic polypeptide
DIQMTQSPSSLSASVGDRVTITCRASQSIITYLNWYQQKPGKAPKLLIYAATSLHSGVPSRFSGSGSGTDFTLTISSLQPEDFATYYCQQSYDNPLTFGGGTKVEIK

SEQ ID NO: 1542 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYDNPLTFGGGTKVEIK

SEQ ID NO: 1543 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYDLPLTFGGGTKVEIK

SEQ ID NO: 1544 - protein, 107 aa, Artificial Sequence
  synthetic polypeptide
DIQMTQSPSSLSASVGDRVTITCRASQSILTYLNWYQQKPGKAPKLLIYATTSRHSGVPSRFSGSGSGTDFTLTISSLQPEDFATYYCQQSYESPLTFGGGTKVEIK

SEQ ID NO: 1545 - protein, 107 aa, Artificial Sequence; identical to SEQ ID NO: 1207
  synthetic polypeptide

SEQ ID NO: 1546 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYNLPLTFGGGTKVEIK

SEQ ID NO: 1547 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSYDLPLTFGGGTKVEIK

SEQ ID NO: 1548 - protein, 107 aa, Artificial Sequence; identical to SEQ ID NO: 573
  synthetic polypeptide

SEQ ID NO: 1549 - protein, 107 aa, Artificial Sequence
  synthetic polypeptide
DIQMTQSPSSLSASVGDRVTITCRASQSIVTYLNWYQQKPGKAPKLLIYAASSLQSGVPSRFSGSGSGTDFTLTISSLQPEDFATYYCQQSYSTPLTFGGGTKVEIK

SEQ ID NO: 1550 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYETPLTFGGGTKVEIK

SEQ ID NO: 1551 - protein, 107 aa, Artificial Sequence; identical to SEQ ID NO: 1331
  synthetic polypeptide

SEQ ID NO: 1552 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSYETPLTFGGGTKVEIK

SEQ ID NO: 1553 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYSSPLTFGGGTKVEIK

SEQ ID NO: 1554 - protein, 107 aa, Artificial Sequence; identical to SEQ ID NO: 1306
  synthetic polypeptide

SEQ ID NO: 1555 - protein, 107 aa, Artificial Sequence; identical to SEQ ID NO: 1343
  synthetic polypeptide

SEQ ID NO: 1556 - protein, 107 aa, Artificial Sequence
  synthetic polypeptide
DIQMTQSPSSLSASVGDRVTITCRASQSIVTYLNWYQQKPGKAPKLLIYAATSLASGVPSRFSGSGSGTDFTLTISSLQPEDFATYYCQQSYNTPLTFGGGTKVEIK

SEQ ID NO: 1557 - protein, 107 aa, Artificial Sequence
  synthetic polypeptide
DIQMTQSPSSLSASVGDRVTITCRASQSILSYLNWYQQKPGKAPKLVIYAATSRHSGVPSRFSGSGSGTDFTLTISSLQPEDFATYYCQQSYDTPLTFGGGTKVEIK

SEQ ID NO: 1558 - protein, 107 aa, Artificial Sequence
  synthetic polypeptide
DIQMTQSPSSLSASVGDRVTITCRASQSIISYVNWYQQKPGKAPKLLIYAATSLASGVPSRFSGSGSGTDFTLTISSLQPEDFATYYCQQSYDTPLTFGGGTKVEIK

SEQ ID NO: 1559 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSYDLPLTFGGGTKVEIK

SEQ ID NO: 1560 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYDNPLTFGGGTKVEIK

SEQ ID NO: 1561 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYDNPLTFGGGTKVEIK

SEQ ID NO: 1562 - protein, 107 aa, Artificial Sequence; identical to SEQ ID NO: 1258
  synthetic polypeptide

SEQ ID NO: 1563 - protein, 107 aa, Artificial Sequence [sequence omitted]

SEQ ID NO: 1564 - protein, 107 aa, Artificial Sequence; identical to SEQ ID NO: 1225
  synthetic polypeptide

SEQ ID NO: 1565 - protein, 107 aa, Artificial Sequence; identical to SEQ ID NO: 1306
  synthetic polypeptide

SEQ ID NO: 1566 - protein, 107 aa, Artificial Sequence; identical to SEQ ID NO: 1318
  synthetic polypeptide

SEQ ID NO: 1567 - protein, 107 aa, Artificial Sequence; identical to SEQ ID NO: 1287
  synthetic polypeptide

SEQ ID NO: 1568 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYNTPLTFGGGTKVEIK

SEQ ID NO: 1569 - protein, 107 aa, Artificial Sequence; identical to SEQ ID NO: 1258
  synthetic polypeptide

SEQ ID NO: 1570 - protein, 6 aa, Artificial Sequence
  synthetic polypeptide
SSYSMN

SEQ ID NO: 1571 - protein, 6 aa, Artificial Sequence
  synthetic polypeptide
SSYGMH

SEQ ID NO: 1572 - protein, 6 aa, Artificial Sequence
  synthetic polypeptide
DSYSMN

SEQ ID NO: 1573 - protein, 6 aa, Artificial Sequence
  synthetic polypeptide
DSYSMN

SEQ ID NO: 1574 - protein, 6 aa, Artificial Sequence
  synthetic polypeptide
SSYSMH

SEQ ID NO: 1575 - protein, 6 aa, Artificial Sequence
  synthetic polypeptide
SSYGMN

SEQ ID NO: 1576 - protein, 6 aa, Artificial Sequence
  synthetic polypeptide
SSYSMN

SEQ ID NO: 1577 - protein, 6 aa, Artificial Sequence
  synthetic polypeptide
DDYSMN

SEQ ID NO: 1578 - protein, 6 aa, Artificial Sequence
  synthetic polypeptide
SSYGMN

SEQ ID NO: 1579 - protein, 6 aa, Artificial Sequence
  synthetic polypeptide
SSYGMN

SEQ ID NO: 1580 - protein, 6 aa, Artificial Sequence
  synthetic polypeptide
SSYGMH

SEQ ID NO: 1581 - protein, 6 aa, Artificial Sequence
  synthetic polypeptide
SSYGMN

SEQ ID NO: 1582 - protein, 6 aa, Artificial Sequence
  synthetic polypeptide
DDYSMN

SEQ ID NO: 1583 - protein, 6 aa, Artificial Sequence
  synthetic polypeptide
DSYGMN

SEQ ID NO: 1584 - protein, 6 aa, Artificial Sequence
  synthetic polypeptide
SSYSMN

SEQ ID NO: 1585 - protein, 6 aa, Artificial Sequence
  synthetic polypeptide
DSYSMH

SEQ ID NO: 1586 - protein, 6 aa, Artificial Sequence
  synthetic polypeptide
SDYSMN

SEQ ID NO: 1587 - protein, 6 aa, Artificial Sequence
  synthetic polypeptide
DSYGMN

SEQ ID NO: 1588 - protein, 6 aa, Artificial Sequence
  synthetic polypeptide
SDYSMN

SEQ ID NO: 1589 - protein, 6 aa, Artificial Sequence
  synthetic polypeptide
SSYGMH

SEQ ID NO: 1590 - protein, 6 aa, Artificial Sequence
  synthetic polypeptide
DSYSMH

SEQ ID NO: 1591 - protein, 6 aa, Artificial Sequence
  synthetic polypeptide
SSYGMH

SEQ ID NO: 1592 - protein, 6 aa, Artificial Sequence
  synthetic polypeptide
SSYGMN

SEQ ID NO: 1593 - protein, 6 aa, Artificial Sequence
  synthetic polypeptide
SSYGMN

SEQ ID NO: 1594 - protein, 6 aa, Artificial Sequence
  synthetic polypeptide
SDYSMN

SEQ ID NO: 1595 - protein, 6 aa, Artificial Sequence
  synthetic polypeptide
DDYGMN

SEQ ID NO: 1596 - protein, 6 aa, Artificial Sequence
  synthetic polypeptide
SSYGMN

SEQ ID NO: 1597 - protein, 6 aa, Artificial Sequence
  synthetic polypeptide
DDYSMH

SEQ ID NO: 1598 - protein, 6 aa, Artificial Sequence
  synthetic polypeptide
SSYSMN

SEQ ID NO: 1599 - protein, 6 aa, Artificial Sequence
  synthetic polypeptide
SSYSMH

SEQ ID NO: 1600 - protein, 6 aa, Artificial Sequence
  synthetic polypeptide
DSYGMH

SEQ ID NO: 1601 - protein, 6 aa, Artificial Sequence
  synthetic polypeptide
DSYGMH

SEQ ID NO: 1602 - protein, 6 aa, Artificial Sequence
  synthetic polypeptide
DSYGMN

SEQ ID NO: 1603 - protein, 6 aa, Artificial Sequence
  synthetic polypeptide
SSYGMN

SEQ ID NO: 1604 - protein, 6 aa, Artificial Sequence
  synthetic polypeptide
SDYSMN

SEQ ID NO: 1605 - protein, 6 aa, Artificial Sequence
  synthetic polypeptide
SDYGMN

SEQ ID NO: 1606 - protein, 6 aa, Artificial Sequence
  synthetic polypeptide
SSYSMN

SEQ ID NO: 1607 - protein, 6 aa, Artificial Sequence
  synthetic polypeptide
SSYSMN

SEQ ID NO: 1608 - protein, 6 aa, Artificial Sequence
  synthetic polypeptide
SSYGMH

SEQ ID NO: 1609 - protein, 6 aa, Artificial Sequence
  synthetic polypeptide
SSYSMN

SEQ ID NO: 1610 - protein, 6 aa, Artificial Sequence
  synthetic polypeptide
DDYSMN

SEQ ID NO: 1611 - protein, 6 aa, Artificial Sequence
  synthetic polypeptide
SSYSMN

SEQ ID NO: 1612 - protein, 6 aa, Artificial Sequence
  synthetic polypeptide
SSYSMN

SEQ ID NO: 1613 - protein, 6 aa, Artificial Sequence
  synthetic polypeptide
SDYSMN

SEQ ID NO: 1614 - protein, 6 aa, Artificial Sequence
  synthetic polypeptide
SSYSMN

SEQ ID NO: 1615 - protein, 6 aa, Artificial Sequence
  synthetic polypeptide
SSYSMN

SEQ ID NO: 1616 - protein, 6 aa, Artificial Sequence
  synthetic polypeptide
DSYSMN

SEQ ID NO: 1617 - protein, 6 aa, Artificial Sequence
  synthetic polypeptide
SSYSMN

SEQ ID NO: 1618 - protein, 6 aa, Artificial Sequence
  synthetic polypeptide
SDYSMN

SEQ ID NO: 1619 - protein, 6 aa, Artificial Sequence
  synthetic polypeptide
SSYSMN

SEQ ID NO: 1620 - protein, 6 aa, Artificial Sequence
  synthetic polypeptide
SSYGMN

SEQ ID NO: 1621 - protein, 6 aa, Artificial Sequence
  synthetic polypeptide
SSYGMN

SEQ ID NO: 1622 - protein, 6 aa, Artificial Sequence
  synthetic polypeptide
DSYGMN

SEQ ID NO: 1623 - protein, 6 aa, Artificial Sequence
  synthetic polypeptide
SDYSMN

SEQ ID NO: 1624 - protein, 6 aa, Artificial Sequence
  synthetic polypeptide
SDYSMN

SEQ ID NO: 1625 - protein, 6 aa, Artificial Sequence
  synthetic polypeptide
SSYSMN

SEQ ID NO: 1626 - protein, 6 aa, Artificial Sequence
  synthetic polypeptide
DDYSMN

SEQ ID NO: 1627 - protein, 6 aa, Artificial Sequence
  synthetic polypeptide
DSYSMN

SEQ ID NO: 1628 - protein, 6 aa, Artificial Sequence
  synthetic polypeptide
SSYSMN

SEQ ID NO: 1629 - protein, 6 aa, Artificial Sequence
  synthetic polypeptide
DSYGMN

SEQ ID NO: 1630 - protein, 6 aa, Artificial Sequence
  synthetic polypeptide
SSYSMN

SEQ ID NO: 1631 - protein, 6 aa, Artificial Sequence
  synthetic polypeptide
SSYSMN

SEQ ID NO: 1632 - protein, 6 aa, Artificial Sequence
  synthetic polypeptide
SDYSMN

SEQ ID NO: 1633 - protein, 6 aa, Artificial Sequence
  synthetic polypeptide
DSYSMN

SEQ ID NO: 1634 - protein, 6 aa, Artificial Sequence
  synthetic polypeptide
SSYSMN

SEQ ID NO: 1635 - protein, 6 aa, Artificial Sequence
  synthetic polypeptide
SSYSMN

SEQ ID NO: 1636 - protein, 6 aa, Artificial Sequence
  synthetic polypeptide
SDYSMN

SEQ ID NO: 1637 - protein, 6 aa, Artificial Sequence
  synthetic polypeptide
SSYSMN

SEQ ID NO: 1638 - protein, 6 aa, Artificial Sequence
  synthetic polypeptide
SSYSMN

SEQ ID NO: 1639 - protein, 6 aa, Artificial Sequence
  synthetic polypeptide
SDYSMN

SEQ ID NO: 1640 - protein, 6 aa, Artificial Sequence
  synthetic polypeptide
SSYGMH

SEQ ID NO: 1641 - protein, 6 aa, Artificial Sequence
  synthetic polypeptide
SSYGMH

SEQ ID NO: 1642 - protein, 6 aa, Artificial Sequence
  synthetic polypeptide
SSYSMN

SEQ ID NO: 1643 - protein, 6 aa, Artificial Sequence
  synthetic polypeptide
DSYSMN

SEQ ID NO: 1644 - protein, 6 aa, Artificial Sequence
  synthetic polypeptide
SSYSMN

SEQ ID NO: 1645 - protein, 6 aa, Artificial Sequence
  synthetic polypeptide
SSYSMN

SEQ ID NO: 1646 - protein, 6 aa, Artificial Sequence
  synthetic polypeptide
SSYSMN

SEQ ID NO: 1647 - protein, 6 aa, Artificial Sequence
  synthetic polypeptide
SSYSMN

SEQ ID NO: 1648 - protein, 6 aa, Artificial Sequence
  synthetic polypeptide
SDYGMN

SEQ ID NO: 1649 - protein, 6 aa, Artificial Sequence
  synthetic polypeptide
SSYSMN

SEQ ID NO: 1650 - protein, 6 aa, Artificial Sequence
  synthetic polypeptide
SSYSMN

SEQ ID NO: 1651 - protein, 6 aa, Artificial Sequence
  synthetic polypeptide
DSYGMN

SEQ ID NO: 1652 - protein, 6 aa, Artificial Sequence
  synthetic polypeptide
SSYSMN

SEQ ID NO: 1653 - protein, 6 aa, Artificial Sequence
  synthetic polypeptide
SSYSMN

SEQ ID NO: 1654 - protein, 6 aa, Artificial Sequence
  synthetic polypeptide
DSYSMN

SEQ ID NO: 1655 - protein, 6 aa, Artificial Sequence
  synthetic polypeptide
SSYSMN

SEQ ID NO: 1656 - protein, 6 aa, Artificial Sequence
  synthetic polypeptide
SSYGMN

SEQ ID NO: 1657 - protein, 6 aa, Artificial Sequence
  synthetic polypeptide
SSYSMN

SEQ ID NO: 1658 - protein, 6 aa, Artificial Sequence
  synthetic polypeptide
SSYSMN

SEQ ID NO: 1659 - protein, 6 aa, Artificial Sequence
  synthetic polypeptide
SSYSMN

SEQ ID NO: 1660 - protein, 6 aa, Artificial Sequence
  synthetic polypeptide
SSYSMN

SEQ ID NO: 1661 - protein, 6 aa, Artificial Sequence
  synthetic polypeptide
SSYSMN

SEQ ID NO: 1662 - protein, 6 aa, Artificial Sequence
  synthetic polypeptide
SSYSMN

SEQ ID NO: 1663 - protein, 13 aa, Artificial Sequence
  synthetic polypeptide
WVASINYNGGYKS

SEQ ID NO: 1664 - protein, 13 aa, Artificial Sequence
  synthetic polypeptide
WVASINYNGGYTS

SEQ ID NO: 1665 - protein, 13 aa, Artificial Sequence
  synthetic polypeptide
WVSNINYNGGYKG

SEQ ID NO: 1666 - protein, 13 aa, Artificial Sequence
  synthetic polypeptide
WVANINYNGGYKG

SEQ ID NO: 1667 - protein, 13 aa, Artificial Sequence
  synthetic polypeptide
WVASINYNGGYTS

SEQ ID NO: 1668 - protein, 13 aa, Artificial Sequence
  synthetic polypeptide
WVSSINYNSGYKS

SEQ ID NO: 1669 - protein, 13 aa, Artificial Sequence
  synthetic polypeptide
WVAGINYNGGYTG

SEQ ID NO: 1670 - protein, 13 aa, Artificial Sequence
  synthetic polypeptide
WVSSINYNGGYKS

SEQ ID NO: 1671 - protein, 13 aa, Artificial Sequence
  synthetic polypeptide
WVASINYNGGYTS

SEQ ID NO: 1672 - protein, 13 aa, Artificial Sequence
  synthetic polypeptide
WVAGINYNGGYTS

SEQ ID NO: 1673 - protein, 13 aa, Artificial Sequence
  synthetic polypeptide
WVSNINYNGGYKS

SEQ ID NO: 1674 - protein, 13 aa, Artificial Sequence
  synthetic polypeptide
WVSSINYNGGYTS

SEQ ID NO: 1675 - protein, 13 aa, Artificial Sequence
  synthetic polypeptide
WVASINYNSGYTG

SEQ ID NO: 1676 - protein, 13 aa, Artificial Sequence
  synthetic polypeptide
WVSSINYNSGYKG

SEQ ID NO: 1677 - protein, 13 aa, Artificial Sequence
  synthetic polypeptide
WVANINYNGGYTG

SEQ ID NO: 1678 - protein, 13 aa, Artificial Sequence
  synthetic polypeptide
WVAGINYNGGYTS

SEQ ID NO: 1679 - protein, 13 aa, Artificial Sequence
  synthetic polypeptide
WVSSINYNGGYKS

SEQ ID NO: 1680 - protein, 13 aa, Artificial Sequence
  synthetic polypeptide
WVASINYNGGYKS

SEQ ID NO: 1681 - protein, 13 aa, Artificial Sequence
  synthetic polypeptide
WVSSINYNGGYKG

SEQ ID NO: 1682 - protein, 13 aa, Artificial Sequence
  synthetic polypeptide
WVASINYNGGYTS

SEQ ID NO: 1683 - protein, 13 aa, Artificial Sequence
  synthetic polypeptide
WVAGINYNGGYTS

SEQ ID NO: 1684 - protein, 13 aa, Artificial Sequence
  synthetic polypeptide
WVASINYNSGYKS

SEQ ID NO: 1685 - protein, 13 aa, Artificial Sequence
  synthetic polypeptide
WVASINYNGGYTG

SEQ ID NO: 1686 - protein, 13 aa, Artificial Sequence
  synthetic polypeptide
WVSGINYNSGYKS

SEQ ID NO: 1687 - protein, 13 aa, Artificial Sequence
  synthetic polypeptide
WVSSINYNSGYKS

SEQ ID NO: 1688 - protein, 13 aa, Artificial Sequence
  synthetic polypeptide
WVSNINYNGGYTG

SEQ ID NO: 1689 - protein, 13 aa, Artificial Sequence
  synthetic polypeptide
WVSSINYNGGYTS

SEQ ID NO: 1690 - protein, 13 aa, Artificial Sequence
  synthetic polypeptide
WVANINYNSGYTG

SEQ ID NO: 1691 - protein, 13 aa, Artificial Sequence
  synthetic polypeptide
WVSGINYNSGYTS

SEQ ID NO: 1692 - protein, 13 aa, Artificial Sequence
  synthetic polypeptide
WVSSINYNGGYTS

SEQ ID NO: 1693 - protein, 13 aa, Artificial Sequence
  synthetic polypeptide
WVANINYNGGYKS

SEQ ID NO: 1694 - protein, 13 aa, Artificial Sequence
  synthetic polypeptide
WVASINYNGGYTS

SEQ ID NO: 1695 - protein, 13 aa, Artificial Sequence
  synthetic polypeptide
WVANINYNGGYKG

SEQ ID NO: 1696 - protein, 13 aa, Artificial Sequence
  synthetic polypeptide
WVANINYNGGYKG

SEQ ID NO: 1697 - protein, 13 aa, Artificial Sequence
  synthetic polypeptide
WVASINYNGGYKG

SEQ ID NO: 1698 - protein, 13 aa, Artificial Sequence
  synthetic polypeptide
WVANINYNGGYKS

SEQ ID NO: 1699 - protein, 13 aa, Artificial Sequence
  synthetic polypeptide
WVASINYNSGYTG

SEQ ID NO: 1700 - protein, 13 aa, Artificial Sequence
  synthetic polypeptide
WVSGINYNGGYKS

SEQ ID NO: 1701 - protein, 13 aa, Artificial Sequence
  synthetic polypeptide
WVAGINYNGGYTS

SEQ ID NO: 1702 - protein, 13 aa, Artificial Sequence
  synthetic polypeptide
WVAGINYNGGYTS

SEQ ID NO: 1703 - protein, 13 aa, Artificial Sequence
  synthetic polypeptide
WVSNINYNGGYKS

SEQ ID NO: 1704 - protein, 13 aa, Artificial Sequence
  synthetic polypeptide
WVAGINYNSGYKS

SEQ ID NO: 1705 - protein, 13 aa, Artificial Sequence
  synthetic polypeptide
WVAGINYNGGYKS

SEQ ID NO: 1706 - protein, 13 aa, Artificial Sequence
  synthetic polypeptide
WVANINYNGGYTG

SEQ ID NO: 1707 - protein, 13 aa, Artificial Sequence
  synthetic polypeptide
WVANINYNGGYKS

SEQ ID NO: 1708 - protein, 13 aa, Artificial Sequence
  synthetic polypeptide
WVANINYNGGYKS

SEQ ID NO: 1709 - protein, 13 aa, Artificial Sequence
  synthetic polypeptide
WVSNINYNSGYKG

SEQ ID NO: 1710 - protein, 13 aa, Artificial Sequence
  synthetic polypeptide
WVASINYNGGYTS

SEQ ID NO: 1711 - protein, 13 aa, Artificial Sequence
  synthetic polypeptide
WVSGINYNSGYTS

SEQ ID NO: 1712 - protein, 13 aa, Artificial Sequence
  synthetic polypeptide
WVANINYNGGYKG

SEQ ID NO: 1713 - protein, 13 aa, Artificial Sequence
  synthetic polypeptide
WVSNINYNGGYKG

SEQ ID NO: 1714 - protein, 13 aa, Artificial Sequence
  synthetic polypeptide
WVSNINYNGGYTS

SEQ ID NO: 1715 - protein, 13 aa, Artificial Sequence
  synthetic polypeptide
WVANINYNGGYTG

SEQ ID NO: 1716 - protein, 13 aa, Artificial Sequence
  synthetic polypeptide
WVANINYNGGYTG

SEQ ID NO: 1717 - protein, 13 aa, Artificial Sequence
  synthetic polypeptide
WVAGINYNGGYTG

SEQ ID NO: 1718 - protein, 13 aa, Artificial Sequence
  synthetic polypeptide
WVSNINYNGGYTG

SEQ ID NO: 1719 - protein, 13 aa, Artificial Sequence
  synthetic polypeptide
WVANINYNGGYTG

SEQ ID NO: 1720 - protein, 13 aa, Artificial Sequence
  synthetic polypeptide
WVSNINYNSGYTG

SEQ ID NO: 1721 - protein, 13 aa, Artificial Sequence
  synthetic polypeptide
WVSSINYNGGYTS

SEQ ID NO: 1722 - protein, 13 aa, Artificial Sequence
  synthetic polypeptide
WVSNINYNGGYTG

SEQ ID NO: 1723 - protein, 13 aa, Artificial Sequence
  synthetic polypeptide
WVAGINYNGGYTS

SEQ ID NO: 1724 - protein, 13 aa, Artificial Sequence
  synthetic polypeptide
WVSNINYNSGYKS

SEQ ID NO: 1725 - protein, 13 aa, Artificial Sequence
  synthetic polypeptide
WVSGINYNSGYTS

SEQ ID NO: 1726 - protein, 13 aa, Artificial Sequence
  synthetic polypeptide
WVSGINYNSGYKS

SEQ ID NO: 1727 - protein, 13 aa, Artificial Sequence
  synthetic polypeptide
WVSGINYNGGYTS

SEQ ID NO: 1728 - protein, 13 aa, Artificial Sequence
  synthetic polypeptide
WVAGINYNGGYTS

SEQ ID NO: 1729 - protein, 13 aa, Artificial Sequence
  synthetic polypeptide
WVSNINYNGGYTS

SEQ ID NO: 1730 - protein, 13 aa, Artificial Sequence
  synthetic polypeptide
WVSGINYNGGYKG

SEQ ID NO: 1731 - protein, 13 aa, Artificial Sequence
  synthetic polypeptide
WVSSINYNSGYTS

SEQ ID NO: 1732 - protein, 13 aa, Artificial Sequence
  synthetic polypeptide
WVSNINYNGGYTS

SEQ ID NO: 1733 - protein, 13 aa, Artificial Sequence
  synthetic polypeptide
WVASINYNGGYTS

SEQ ID NO: 1734 - protein, 13 aa, Artificial Sequence
  synthetic polypeptide
WVAGINYNGGYTS

SEQ ID NO: 1735 - protein, 13 aa, Artificial Sequence
  synthetic polypeptide
WVSGINYNGGYKS

SEQ ID NO: 1736 - protein, 13 aa, Artificial Sequence
  synthetic polypeptide
WVSGINYNGGYKS

SEQ ID NO: 1737 - protein, 13 aa, Artificial Sequence
  synthetic polypeptide
WVAGINYNGGYTS

SEQ ID NO: 1738 - protein, 13 aa, Artificial Sequence
  synthetic polypeptide
WVSGINYNSGYKS

SEQ ID NO: 1739 - protein, 13 aa, Artificial Sequence
  synthetic polypeptide
WVSGINYNGGYTS

SEQ ID NO: 1740 - protein, 13 aa, Artificial Sequence
  synthetic polypeptide
WVAGINYNGGYTS

SEQ ID NO: 1741 - protein, 13 aa, Artificial Sequence
  synthetic polypeptide
WVANINYNGGYKG

SEQ ID NO: 1742 - protein, 13 aa, Artificial Sequence
  synthetic polypeptide
WVSSINYNGGYKG

SEQ ID NO: 1743 - protein, 13 aa, Artificial Sequence
  synthetic polypeptide
WVAGINYNGGYTS

SEQ ID NO: 1744 - protein, 13 aa, Artificial Sequence
  synthetic polypeptide
WVANINYNGGYKG

SEQ ID NO: 1745 - protein, 13 aa, Artificial Sequence
  synthetic polypeptide
WVSNINYNSGYKG

SEQ ID NO: 1746 - protein, 13 aa, Artificial Sequence
  synthetic polypeptide
WVAGINYNGGYTS

SEQ ID NO: 1747 - protein, 13 aa, Artificial Sequence
  synthetic polypeptide
WVAGINYNGGYTS

SEQ ID NO: 1748 - protein, 13 aa, Artificial Sequence
  synthetic polypeptide
WVAGINYNGGYTS

SEQ ID NO: 1749 - protein, 13 aa, Artificial Sequence
  synthetic polypeptide
WVSSINYNGGYKG

SEQ ID NO: 1750 - protein, 13 aa, Artificial Sequence
  synthetic polypeptide
WVSSINYNGGYTS

SEQ ID NO: 1751 - protein, 13 aa, Artificial Sequence
  synthetic polypeptide
WVSGINYNGGYTG

SEQ ID NO: 1752 - protein, 13 aa, Artificial Sequence
  synthetic polypeptide
WVSGINYNGGYTS

SEQ ID NO: 1753 - protein, 13 aa, Artificial Sequence
  synthetic polypeptide
WVAGINYNGGYKS

SEQ ID NO: 1754 - protein, 13 aa, Artificial Sequence
  synthetic polypeptide
WVAGINYNSGYKG

SEQ ID NO: 1755 - protein, 13 aa, Artificial Sequence
  synthetic polypeptide
WVSGINYNGGYKS

SEQ ID NO: 1756 - protein, 12 aa, Artificial Sequence
  synthetic polypeptide
ARGATWHDTHLD

SEQ ID NO: 1757 - protein, 12 aa, Artificial Sequence
  synthetic polypeptide
ARGATWHDTHLD

SEQ ID NO: 1758 - protein, 12 aa, Artificial Sequence
  synthetic polypeptide
ARGATWHDTHLD

SEQ ID NO: 1759 - protein, 12 aa, Artificial Sequence
  synthetic polypeptide
ARGATWHDTHLD

SEQ ID NO: 1760 - protein, 12 aa, Artificial Sequence
  synthetic polypeptide
ARGATWHDTHLD

SEQ ID NO: 1761 - protein, 12 aa, Artificial Sequence
  synthetic polypeptide
ARGATWHDTHLD

SEQ ID NO: 1762 - protein, 12 aa, Artificial Sequence
  synthetic polypeptide
ARGATWHDTHLD

SEQ ID NO: 1763 - protein, 12 aa, Artificial Sequence
  synthetic polypeptide
ARGATWHDTHLD

SEQ ID NO: 1764 - protein, 12 aa, Artificial Sequence
  synthetic polypeptide
ARGATWHDTHLD

SEQ ID NO: 1765 - protein, 12 aa, Artificial Sequence
  synthetic polypeptide
ARGATWHDTHLD

SEQ ID NO: 1766 - protein, 12 aa, Artificial Sequence
  synthetic polypeptide
ARGATWHDTHLD

SEQ ID NO: 1767 - protein, 12 aa, Artificial Sequence
  synthetic polypeptide
ARGATWHDTHLD

SEQ ID NO: 1768 - protein, 12 aa, Artificial Sequence
  synthetic polypeptide
ARGATWHDTHLD

SEQ ID NO: 1769 - protein, 12 aa, Artificial Sequence
  synthetic polypeptide
ARGATWHDTHLD

SEQ ID NO: 1770 - protein, 12 aa, Artificial Sequence
  synthetic polypeptide
ARGATWHDTHLD

SEQ ID NO: 1771 - protein, 12 aa, Artificial Sequence
  synthetic polypeptide
ARGATWHDTHLD

SEQ ID NO: 1772 - protein, 12 aa, Artificial Sequence
  synthetic polypeptide
ARGATWHDTHLD

SEQ ID NO: 1773 - protein, 12 aa, Artificial Sequence
  synthetic polypeptide
ARGATWHDTHLD

SEQ ID NO: 1774 - protein, 12 aa, Artificial Sequence
  synthetic polypeptide
ARGATWHDTHLD

SEQ ID NO: 1775 - protein, 12 aa, Artificial Sequence
  synthetic polypeptide
ARGATWHDTHLD

SEQ ID NO: 1776 - protein, 12 aa, Artificial Sequence
  synthetic polypeptide
ARGATWHDTHLD

SEQ ID NO: 1777 - protein, 12 aa, Artificial Sequence
  synthetic polypeptide
ARGATWHDTHLD

SEQ ID NO: 1778 - protein, 12 aa, Artificial Sequence
  synthetic polypeptide
ARGATWHDTHLD

SEQ ID NO: 1779 - protein, 12 aa, Artificial Sequence
  synthetic polypeptide
ARGATWHDTHLD

SEQ ID NO: 1780 - protein, 12 aa, Artificial Sequence
  synthetic polypeptide
ARGATWHDTHLD

SEQ ID NO: 1781 - protein, 12 aa, Artificial Sequence
  synthetic polypeptide
ARGATWHDTHLD

SEQ ID NO: 1782 - protein, 12 aa, Artificial Sequence
  synthetic polypeptide
ARGATWHDTHLD

SEQ ID NO: 1783 - protein, 12 aa, Artificial Sequence
  synthetic polypeptide
ARGATWHDTHLD

SEQ ID NO: 1784 - protein, 12 aa, Artificial Sequence
  synthetic polypeptide
ARGATWHDTALD

SEQ ID NO: 1785 - protein, 12 aa, Artificial Sequence
  synthetic polypeptide
ARGATWHDTHLD

SEQ ID NO: 1786 - protein, 12 aa, Artificial Sequence
  synthetic polypeptide
ARGATWHDTHLD

SEQ ID NO: 1787 - protein, 12 aa, Artificial Sequence
  synthetic polypeptide
ARGATWHDTHLD

SEQ ID NO: 1788 - protein, 12 aa, Artificial Sequence
  synthetic polypeptide
ARGATWHDTHLD

SEQ ID NO: 1789 - protein, 12 aa, Artificial Sequence
  synthetic polypeptide
ARGATWHDTHLD

SEQ ID NO: 1790 - protein, 12 aa, Artificial Sequence
  synthetic polypeptide
ARGATWHDTHLD

SEQ ID NO: 1791 - protein, 12 aa, Artificial Sequence
  synthetic polypeptide
ARGATWHDTHLD

SEQ ID NO: 1792 - protein, 12 aa, Artificial Sequence
  synthetic polypeptide
ARGATWHDTHLD

SEQ ID NO: 1793 - protein, 12 aa, Artificial Sequence
  synthetic polypeptide
ARGATWHDTHLD

SEQ ID NO: 1794 - protein, 12 aa, Artificial Sequence
  synthetic polypeptide
ARGATWHDTHLD

SEQ ID NO: 1795 - protein, 12 aa, Artificial Sequence
  synthetic polypeptide
ARGATWHDTHLD

SEQ ID NO: 1796 - protein, 12 aa, Artificial Sequence
  synthetic polypeptide
ARGATWHDTHLD

SEQ ID NO: 1797 - protein, 12 aa, Artificial Sequence
  synthetic polypeptide
ARGATWHDTHLD

SEQ ID NO: 1798 - protein, 12 aa, Artificial Sequence
  synthetic polypeptide
ARGATWHDTHLD

SEQ ID NO: 1799 - protein, 12 aa, Artificial Sequence
  synthetic polypeptide
ARGATWHDTHLD

SEQ ID NO: 1800 - protein, 12 aa, Artificial Sequence
  synthetic polypeptide
ARGATWHDTHLD

SEQ ID NO: 1801 - protein, 12 aa, Artificial Sequence
  synthetic polypeptide
ARGATWHDTHLD

SEQ ID NO: 1802 - protein, 12 aa, Artificial Sequence
  synthetic polypeptide
ARGATWHDTHLD

SEQ ID NO: 1803 - protein, 12 aa, Artificial Sequence
  synthetic polypeptide
ARGATWHDTHLD

SEQ ID NO: 1804 - protein, 12 aa, Artificial Sequence
  synthetic polypeptide
ARGATWHDTHLD

SEQ ID NO: 1805 - protein, 12 aa, Artificial Sequence
  synthetic polypeptide
ARGATWHDTHLD

SEQ ID NO: 1806 - protein, 12 aa, Artificial Sequence
  synthetic polypeptide
ARGATWHDTHLD

SEQ ID NO: 1807 - protein, 12 aa, Artificial Sequence
  synthetic polypeptide
ARGATWHDTHLD

SEQ ID NO: 1808 - protein, 12 aa, Artificial Sequence
  synthetic polypeptide
ARGATWHDTHLD

SEQ ID NO: 1809 - protein, 12 aa, Artificial Sequence
  synthetic polypeptide
ARGATWHDTHLD

SEQ ID NO: 1810 - protein, 12 aa, Artificial Sequence
  synthetic polypeptide
ARGATWHDTHLD

SEQ ID NO: 1811 - protein, 12 aa, Artificial Sequence
  synthetic polypeptide
ARGATWHDTHLD

SEQ ID NO: 1812 - protein, 12 aa, Artificial Sequence
  synthetic polypeptide
ARGATWHDTHLD

SEQ ID NO: 1813 - protein, 12 aa, Artificial Sequence
  synthetic polypeptide
ARGATWHDTHLD

SEQ ID NO: 1814 - protein, 12 aa, Artificial Sequence
  synthetic polypeptide
ARGATWHDTHLD

SEQ ID NO: 1815 - protein, 12 aa, Artificial Sequence
  synthetic polypeptide
ARGATWHDTALD

SEQ ID NO: 1816 - protein, 12 aa, Artificial Sequence
  synthetic polypeptide
ARGATWHDTHLD

SEQ ID NO: 1817 - protein, 12 aa, Artificial Sequence
  synthetic polypeptide
ARGATWHDTHLD

SEQ ID NO: 1818 - protein, 12 aa, Artificial Sequence
  synthetic polypeptide
ARGATWHDTHLD

SEQ ID NO: 1819 - protein, 12 aa, Artificial Sequence
  synthetic polypeptide
ARGATWHDTHLD

SEQ ID NO: 1820 - protein, 12 aa, Artificial Sequence
  synthetic polypeptide
ARGATWHDTHLD

SEQ ID NO: 1821 - protein, 12 aa, Artificial Sequence
  synthetic polypeptide
ARGATWHDTHLD

SEQ ID NO: 1822 - protein, 12 aa, Artificial Sequence
  synthetic polypeptide
ARGATWHDTHLD

SEQ ID NO: 1823 - protein, 12 aa, Artificial Sequence
  synthetic polypeptide
ARGATWHDTHLD

SEQ ID NO: 1824 - protein, 12 aa, Artificial Sequence
  synthetic polypeptide
ARGATWHDTHLD

SEQ ID NO: 1825 - protein, 12 aa, Artificial Sequence
  synthetic polypeptide
ARGATWHDTHLD

SEQ ID NO: 1826 - protein, 12 aa, Artificial Sequence
  synthetic polypeptide
ARGATWHDTHLD

SEQ ID NO: 1827 - protein, 12 aa, Artificial Sequence
  synthetic polypeptide
ARGATWHDTHLD

SEQ ID NO: 1828 - protein, 12 aa, Artificial Sequence
  synthetic polypeptide
ARGATWHDTHLD

SEQ ID NO: 1829 - protein, 12 aa, Artificial Sequence
  synthetic polypeptide
ARGATWHDTHLD

SEQ ID NO: 1830 - protein, 12 aa, Artificial Sequence
  synthetic polypeptide
ARGATWHDTHLD

SEQ ID NO: 1831 - protein, 12 aa, Artificial Sequence
  synthetic polypeptide
ARGATWHDTHLD

SEQ ID NO: 1832 - protein, 12 aa, Artificial Sequence
  synthetic polypeptide
ARGATWHDTHLD

SEQ ID NO: 1833 - protein, 12 aa, Artificial Sequence
  synthetic polypeptide
ARGATWHDTHLD

SEQ ID NO: 1834 - protein, 12 aa, Artificial Sequence
  synthetic polypeptide
ARGATWHDTHLD

SEQ ID NO: 1835 - protein, 12 aa, Artificial Sequence
  synthetic polypeptide
ARGATWHDTHLD

SEQ ID NO: 1836 - protein, 12 aa, Artificial Sequence
  synthetic polypeptide
ARGATWHDTHLD

SEQ ID NO: 1837 - protein, 12 aa, Artificial Sequence
  synthetic polypeptide
ARGATWHDTHLD

SEQ ID NO: 1838 - protein, 12 aa, Artificial Sequence
  synthetic polypeptide
ARGATWHDTHLD

SEQ ID NO: 1839 - protein, 12 aa, Artificial Sequence
  synthetic polypeptide
ARGATWHDTHLD

SEQ ID NO: 1840 - protein, 12 aa, Artificial Sequence
  synthetic polypeptide
ARGATWHDTHLD

SEQ ID NO: 1841 - protein, 12 aa, Artificial Sequence
  synthetic polypeptide
ARGATWHDTHLD

SEQ ID NO: 1842 - protein, 12 aa, Artificial Sequence
  synthetic polypeptide
ARGATWHDTHLD

SEQ ID NO: 1843 - protein, 12 aa, Artificial Sequence
  synthetic polypeptide
ARGATWHDTHLD

SEQ ID NO: 1844 - protein, 12 aa, Artificial Sequence
  synthetic polypeptide
ARGATWHDTHLD

SEQ ID NO: 1845 - protein, 12 aa, Artificial Sequence
  synthetic polypeptide
ARGATWHDTHLD

SEQ ID NO: 1846 - protein, 12 aa, Artificial Sequence
  synthetic polypeptide
ARGATWHDTHLD

SEQ ID NO: 1847 - protein, 12 aa, Artificial Sequence
  synthetic polypeptide
ARGATWHDTHLD

SEQ ID NO: 1848 - protein, 12 aa, Artificial Sequence
  synthetic polypeptide
ARGATWHDTHLD

SEQ ID NO: 1849 - protein, 7 aa, Artificial Sequence
  synthetic polypeptide
ITYLNWY

SEQ ID NO: 1850 - protein, 7 aa, Artificial Sequence
  synthetic polypeptide
LSYVNWY

SEQ ID NO: 1851 - protein, 7 aa, Artificial Sequence
  synthetic polypeptide
STYLNWY

SEQ ID NO: 1852 - protein, 7 aa, Artificial Sequence
  synthetic polypeptide
LTYLNWY

SEQ ID NO: 1853 - protein, 7 aa, Artificial Sequence
  synthetic polypeptide
VTYLNWY

SEQ ID NO: 1854 - protein, 7 aa, Artificial Sequence
  synthetic polypeptide
SSYLNWY

SEQ ID NO: 1855 - protein, 7 aa, Artificial Sequence
  synthetic polypeptide
STYLNWY

SEQ ID NO: 1856 - protein, 7 aa, Artificial Sequence
  synthetic polypeptide
SSYLNWY

SEQ ID NO: 1857 - protein, 7 aa, Artificial Sequence
  synthetic polypeptide
VTYVNWY

SEQ ID NO: 1858 - protein, 7 aa, Artificial Sequence
  synthetic polypeptide
LTYVNWY

SEQ ID NO: 1859 - protein, 7 aa, Artificial Sequence
  synthetic polypeptide
LSYVNWY

SEQ ID NO: 1860 - protein, 7 aa, Artificial Sequence
  synthetic polypeptide
SSYLNWY

SEQ ID NO: 1861 - protein, 7 aa, Artificial Sequence
  synthetic polypeptide
LSYVNWY

SEQ ID NO: 1862 - protein, 7 aa, Artificial Sequence
  synthetic polypeptide
ISYLNWY

SEQ ID NO: 1863 - protein, 7 aa, Artificial Sequence
  synthetic polypeptide
ISYVNWY

SEQ ID NO: 1864 - protein, 7 aa, Artificial Sequence
  synthetic polypeptide
LTYLNWY

SEQ ID NO: 1865 - protein, 7 aa, Artificial Sequence
  synthetic polypeptide
ISYVNWY

SEQ ID NO: 1866 - protein, 7 aa, Artificial Sequence
  synthetic polypeptide
LTYLNWY

SEQ ID NO: 1867 - protein, 7 aa, Artificial Sequence
  synthetic polypeptide
LSYVNWY

SEQ ID NO: 1868 - protein, 7 aa, Artificial Sequence
  synthetic polypeptide
LTYVNWY

SEQ ID NO: 1869 - protein, 7 aa, Artificial Sequence
  synthetic polypeptide
LTYLNWY

SEQ ID NO: 1870 - protein, 7 aa, Artificial Sequence
  synthetic polypeptide
LSYVNWY

SEQ ID NO: 1871 - protein, 7 aa, Artificial Sequence
  synthetic polypeptide
LSYVNWY

SEQ ID NO: 1872 - protein, 7 aa, Artificial Sequence
  synthetic polypeptide
SSYLNWY

SEQ ID NO: 1873 - protein, 7 aa, Artificial Sequence
  synthetic polypeptide
ISYLNWY

SEQ ID NO: 1874 - protein, 7 aa, Artificial Sequence
  synthetic polypeptide
STYLNWY

SEQ ID NO: 1875 - protein, 7 aa, Artificial Sequence
  synthetic polypeptide
LSYVNWY

SEQ ID NO: 1876 - protein, 7 aa, Artificial Sequence
  synthetic polypeptide
LSYLNWY

SEQ ID NO: 1877 - protein, 7 aa, Artificial Sequence
  synthetic polypeptide
LSYLNWY

SEQ ID NO: 1878 - protein, 7 aa, Artificial Sequence
  synthetic polypeptide
VSYVNWY

SEQ ID NO: 1879 - protein, 7 aa, Artificial Sequence
  synthetic polypeptide
LTYVNWY

SEQ ID NO: 1880 - protein, 7 aa, Artificial Sequence
  synthetic polypeptide
LSYLNWY

SEQ ID NO: 1881 - protein, 7 aa, Artificial Sequence
  synthetic polypeptide
ITYLNWY

SEQ ID NO: 1882 - protein, 7 aa, Artificial Sequence
  synthetic polypeptide
LTYLNWY

SEQ ID NO: 1883 - protein, 7 aa, Artificial Sequence
  synthetic polypeptide
LTYLNWY

SEQ ID NO: 1884 - protein, 7 aa, Artificial Sequence
  synthetic polypeptide
LTYLNWY

SEQ ID NO: 1885 - protein, 7 aa, Artificial Sequence
  synthetic polypeptide
LTYVNWY

SEQ ID NO: 1886 - protein, 7 aa, Artificial Sequence
  synthetic polypeptide
SSYLNWY

SEQ ID NO: 1887 - protein, 7 aa, Artificial Sequence
  synthetic polypeptide
LTYVNWY

SEQ ID NO: 1888 - protein, 7 aa, Artificial Sequence
  synthetic polypeptide
VSYLNWY

SEQ ID NO: 1889 - protein, 7 aa, Artificial Sequence
  synthetic polypeptide
ISYLNWY

SEQ ID NO: 1890 - protein, 7 aa, Artificial Sequence
  synthetic polypeptide
LSYVNWY

SEQ ID NO: 1891 - protein, 7 aa, Artificial Sequence
  synthetic polypeptide
VTYVNWY

SEQ ID NO: 1892 - protein, 7 aa, Artificial Sequence
  synthetic polypeptide
LSYLNWY

SEQ ID NO: 1893 - protein, 7 aa, Artificial Sequence
  synthetic polypeptide
LTYVNWY

SEQ ID NO: 1894 - protein, 7 aa, Artificial Sequence
  synthetic polypeptide
LSYLNWY

SEQ ID NO: 1895 - protein, 7 aa, Artificial Sequence
  synthetic polypeptide
VSYVNWY

SEQ ID NO: 1896 - protein, 7 aa, Artificial Sequence
  synthetic polypeptide
ITYLNWY

SEQ ID NO: 1897 - protein, 7 aa, Artificial Sequence
  synthetic polypeptide
VTYLNWY

SEQ ID NO: 1898 - protein, 7 aa, Artificial Sequence
  synthetic polypeptide
LTYLNWY

SEQ ID NO: 1899 - protein, 7 aa, Artificial Sequence
  synthetic polypeptide
STYLNWY

SEQ ID NO: 1900 - protein, 7 aa, Artificial Sequence
  synthetic polypeptide
VSYLNWY

SEQ ID NO: 1901 - protein, 7 aa, Artificial Sequence
  synthetic polypeptide
LSYLNWY

SEQ ID NO: 1902 - protein, 7 aa, Artificial Sequence
  synthetic polypeptide
LSYLNWY

SEQ ID NO: 1903 - protein, 7 aa, Artificial Sequence
  synthetic polypeptide
LTYLNWY

SEQ ID NO: 1904 - protein, 7 aa, Artificial Sequence
  synthetic polypeptide
LSYVNWY

SEQ ID NO: 1905 - protein, 7 aa, Artificial Sequence
  synthetic polypeptide
LTYLNWY

SEQ ID NO: 1906 - protein, 7 aa, Artificial Sequence
  synthetic polypeptide
LSYVNWY

SEQ ID NO: 1907 - protein, 7 aa, Artificial Sequence
  synthetic polypeptide
SSYLNWY

SEQ ID NO: 1908 - protein, 7 aa, Artificial Sequence
  synthetic polypeptide
LSYLNWY

SEQ ID NO: 1909 - protein, 7 aa, Artificial Sequence
  synthetic polypeptide
ISYLNWY

SEQ ID NO: 1910 - protein, 7 aa, Artificial Sequence
  synthetic polypeptide
VSYVNWY

SEQ ID NO: 1911 - protein, 7 aa, Artificial Sequence
  synthetic polypeptide
LTYLNWY

SEQ ID NO: 1912 - protein, 7 aa, Artificial Sequence
  synthetic polypeptide
LSYLNWY

SEQ ID NO: 1913 - protein, 7 aa, Artificial Sequence
  synthetic polypeptide
ITYLNWY

SEQ ID NO: 1914 - protein, 7 aa, Artificial Sequence
  synthetic polypeptide
LTYLNWY

SEQ ID NO: 1915 - protein, 7 aa, Artificial Sequence
  synthetic polypeptide
LTYLNWY

SEQ ID NO: 1916 - protein, 7 aa, Artificial Sequence
  synthetic polypeptide
LTYLNWY

SEQ ID NO: 1917 - protein, 7 aa, Artificial Sequence
  synthetic polypeptide
LTYLNWY

SEQ ID NO: 1918 - protein, 7 aa, Artificial Sequence
  synthetic polypeptide
ITYLNWY

SEQ ID NO: 1919 - protein, 7 aa, Artificial Sequence
  synthetic polypeptide
LTYLNWY

SEQ ID NO: 1920 - protein, 7 aa, Artificial Sequence
  synthetic polypeptide
LSYVNWY

SEQ ID NO: 1921 - protein, 7 aa, Artificial Sequence
  synthetic polypeptide
VTYLNWY

SEQ ID NO: 1922 - protein, 7 aa, Artificial Sequence
  synthetic polypeptide
LSYLNWY

SEQ ID NO: 1923 - protein, 7 aa, Artificial Sequence
  synthetic polypeptide
VTYLNWY

SEQ ID NO: 1924 - protein, 7 aa, Artificial Sequence
  synthetic polypeptide
LSYLNWY

SEQ ID NO: 1925 - protein, 7 aa, Artificial Sequence
  synthetic polypeptide
ITYLNWY

SEQ ID NO: 1926 - protein, 7 aa, Artificial Sequence
  synthetic polypeptide
LTYLNWY

SEQ ID NO: 1927 - protein, 7 aa, Artificial Sequence
  synthetic polypeptide
VRYLNWY

SEQ ID NO: 1928 - protein, 7 aa, Artificial Sequence
  synthetic polypeptide
VTYLNWY

SEQ ID NO: 1929 - protein, 7 aa, Artificial Sequence
  synthetic polypeptide
LSYLNWY

SEQ ID NO: 1930 - protein, 7 aa, Artificial Sequence
  synthetic polypeptide
ISYVNWY

SEQ ID NO: 1931 - protein, 7 aa, Artificial Sequence
  synthetic polypeptide
ISYLNWY

SEQ ID NO: 1932 - protein, 7 aa, Artificial Sequence
  synthetic polypeptide
LSYVNWY

SEQ ID NO: 1933 - protein, 7 aa, Artificial Sequence
  synthetic polypeptide
LTYLNWY

SEQ ID NO: 1934 - protein, 7 aa, Artificial Sequence
  synthetic polypeptide
LTYLNWY

SEQ ID NO: 1935 - protein, 7 aa, Artificial Sequence
  synthetic polypeptide
SSYLNWY

SEQ ID NO: 1936 - protein, 7 aa, Artificial Sequence
  synthetic polypeptide
LSYVNWY

SEQ ID NO: 1937 - protein, 7 aa, Artificial Sequence
  synthetic polypeptide
LTYLNWY

SEQ ID NO: 1938 - protein, 7 aa, Artificial Sequence
  synthetic polypeptide
LTYLNWY

SEQ ID NO: 1939 - protein, 7 aa, Artificial Sequence
  synthetic polypeptide
LSYLNWY

SEQ ID NO: 1940 - protein, 7 aa, Artificial Sequence
  synthetic polypeptide
LTYLNWY

SEQ ID NO: 1941 - protein, 7 aa, Artificial Sequence
  synthetic polypeptide
LTYLNWY

SEQ ID NO: 1942 - protein, 10 aa, Artificial Sequence
  synthetic polypeptide
LVIYAATSRA

SEQ ID NO: 1943 - protein, 10 aa, Artificial Sequence
  synthetic polypeptide
LLIYAATSRA

SEQ ID NO: 1944 - protein, 10 aa, Artificial Sequence
  synthetic polypeptide
LVIYAATSRH

SEQ ID NO: 1945 - protein, 10 aa, Artificial Sequence
  synthetic polypeptide
LVIYAATSLA

SEQ ID NO: 1946 - protein, 10 aa, Artificial Sequence
  synthetic polypeptide
LLIYAATSLA

SEQ ID NO: 1947 - protein, 10 aa, Artificial Sequence
  synthetic polypeptide
LLIYAASSLQ

SEQ ID NO: 1948 - protein, 10 aa, Artificial Sequence
  synthetic polypeptide
LLIYAATSRA

SEQ ID NO: 1949 - protein, 10 aa, Artificial Sequence
  synthetic polypeptide
LLIYAASSLQ

SEQ ID NO: 1950 - protein, 10 aa, Artificial Sequence
  synthetic polypeptide
LLIYAATSRA

SEQ ID NO: 1951 - protein, 10 aa, Artificial Sequence
  synthetic polypeptide
LLIYAATSLH

SEQ ID NO: 1952 - protein, 10 aa, Artificial Sequence
  synthetic polypeptide
LVIYAATSLA

SEQ ID NO: 1953 - protein, 10 aa, Artificial Sequence
  synthetic polypeptide
LLIYAASSLQ

SEQ ID NO: 1954 - protein, 10 aa, Artificial Sequence
  synthetic polypeptide
LVIYAATSRA

SEQ ID NO: 1955 - protein, 10 aa, Artificial Sequence
  synthetic polypeptide
LLIYAVTSRA

SEQ ID NO: 1956 - protein, 10 aa, Artificial Sequence
  synthetic polypeptide
LVIYAATSLH

SEQ ID NO: 1957 - protein, 10 aa, Artificial Sequence
  synthetic polypeptide
LLIYAATSLA

SEQ ID NO: 1958 - protein, 10 aa, Artificial Sequence
  synthetic polypeptide
LVIYAATSLA

SEQ ID NO: 1959 - protein, 10 aa, Artificial Sequence
  synthetic polypeptide
LLIYAATSLA

SEQ ID NO: 1960 - protein, 10 aa, Artificial Sequence
  synthetic polypeptide
LVIYAATSRA

SEQ ID NO: 1961 - protein, 10 aa, Artificial Sequence
  synthetic polypeptide
LLIYAASSLQ

SEQ ID NO: 1962 - protein, 10 aa, Artificial Sequence
  synthetic polypeptide
LLIYAATSLA

SEQ ID NO: 1963 - protein, 10 aa, Artificial Sequence
  synthetic polypeptide
LLIYAASSLQ

SEQ ID NO: 1964 - protein, 10 aa, Artificial Sequence
  synthetic polypeptide
LVIYAATSRA

SEQ ID NO: 1965 - protein, 10 aa, Artificial Sequence
  synthetic polypeptide
LLIYAASSLQ

SEQ ID NO: 1966 - protein, 10 aa, Artificial Sequence
  synthetic polypeptide
LLIYAATSRA

SEQ ID NO: 1967 - protein, 10 aa, Artificial Sequence
  synthetic polypeptide
LVIYAATSRH

SEQ ID NO: 1968 - protein, 10 aa, Artificial Sequence
  synthetic polypeptide
LVIYAATSRA

SEQ ID NO: 1969 - protein, 10 aa, Artificial Sequence
  synthetic polypeptide
LVIYATTSRA

SEQ ID NO: 1970 - protein, 10 aa, Artificial Sequence
  synthetic polypeptide
LVIYAATSRA

SEQ ID NO: 1971 - protein, 10 aa, Artificial Sequence
  synthetic polypeptide
LVIYAATSRA

SEQ ID NO: 1972 - protein, 10 aa, Artificial Sequence
  synthetic polypeptide
LLIYATTSRA

SEQ ID NO: 1973 - protein, 10 aa, Artificial Sequence
  synthetic polypeptide
LLIYAATSRA

SEQ ID NO: 1974 - protein, 10 aa, Artificial Sequence
  synthetic polypeptide
LVIYAATSRH

SEQ ID NO: 1975 - protein, 10 aa, Artificial Sequence
  synthetic polypeptide
LLIYAATSRH

SEQ ID NO: 1976 - protein, 10 aa, Artificial Sequence
  synthetic polypeptide
LLIYAATSRA

SEQ ID NO: 1977 - protein, 10 aa, Artificial Sequence
  synthetic polypeptide
LLIYAATSLA

SEQ ID NO: 1978 - protein, 10 aa, Artificial Sequence
  synthetic polypeptide
LLIYAATSRA

SEQ ID NO: 1979 - protein, 10 aa, Artificial Sequence
  synthetic polypeptide
LLIYAASSLQ

SEQ ID NO: 1980 - protein, 10 aa, Artificial Sequence
  synthetic polypeptide
LLIYAATSRA

SEQ ID NO: 1981 - protein, 10 aa, Artificial Sequence
  synthetic polypeptide
LLIYAATSRH

SEQ ID NO: 1982 - protein, 10 aa, Artificial Sequence
  synthetic polypeptide
LLIYAATSRA

SEQ ID NO: 1983 - protein, 10 aa, Artificial Sequence
  synthetic polypeptide
LVIYAATSLA

SEQ ID NO: 1984 - protein, 10 aa, Artificial Sequence
  synthetic polypeptide
LVIYAATSRA

SEQ ID NO: 1985 - protein, 10 aa, Artificial Sequence
  synthetic polypeptide
LLIYAASSLQ

SEQ ID NO: 1986 - protein, 10 aa, Artificial Sequence
  synthetic polypeptide
LLIYAASSLQ

SEQ ID NO: 1987 - protein, 10 aa, Artificial Sequence
  synthetic polypeptide
LLIYAATSRH

SEQ ID NO: 1988 - protein, 10 aa, Artificial Sequence
  synthetic polypeptide
LLIYATTSRA

SEQ ID NO: 1989 - protein, 10 aa, Artificial Sequence
  synthetic polypeptide
LLIYAATSRA

SEQ ID NO: 1990 - protein, 10 aa, Artificial Sequence
  synthetic polypeptide
LVIYAATSRA

SEQ ID NO: 1991 - protein, 10 aa, Artificial Sequence
  synthetic polypeptide
LLIYAVTSLH

SEQ ID NO: 1992 - protein, 10 aa, Artificial Sequence
  synthetic polypeptide
LVIYAVTSRA

SEQ ID NO: 1993 - protein, 10 aa, Artificial Sequence
  synthetic polypeptide
LLIYAATSRA

SEQ ID NO: 1994 - protein, 10 aa, Artificial Sequence
  synthetic polypeptide
LLIYAVTSRH

SEQ ID NO: 1995 - protein, 10 aa, Artificial Sequence
  synthetic polypeptide
LLIYAASSLQ

SEQ ID NO: 1996 - protein, 10 aa, Artificial Sequence
  synthetic polypeptide
LVIYAATSRA

SEQ ID NO: 1997 - protein, 10 aa, Artificial Sequence
  synthetic polypeptide
LLIYAATSRA

SEQ ID NO: 1998 - protein, 10 aa, Artificial Sequence
  synthetic polypeptide
LLIYAATSRA

SEQ ID NO: 1999 - protein, 10 aa, Artificial Sequence
  synthetic polypeptide
LLIYAATSLA

SEQ ID NO: 2000 - protein, 10 aa, Artificial Sequence
  synthetic polypeptide
LLIYAVTSRA

SEQ ID NO: 2001 - protein, 10 aa, Artificial Sequence
  synthetic polypeptide
LLIYAATSLA

SEQ ID NO: 2002 - protein, 10 aa, Artificial Sequence
  synthetic polypeptide
LVIYAATSRA

SEQ ID NO: 2003 - protein, 10 aa, Artificial Sequence
  synthetic polypeptide
LVIYAATSRH

SEQ ID NO: 2004 - protein, 10 aa, Artificial Sequence
  synthetic polypeptide
LLIYAATSRA

SEQ ID NO: 2005 - protein, 10 aa, Artificial Sequence
  synthetic polypeptide
LLIYAATSLA

SEQ ID NO: 2006 - protein, 10 aa, Artificial Sequence
  synthetic polypeptide
LLIYAATSLH

SEQ ID NO: 2007 - protein, 10 aa, Artificial Sequence
  synthetic polypeptide
LLIYAATSRA

SEQ ID NO: 2008 - protein, 10 aa, Artificial Sequence
  synthetic polypeptide
LLIYAATSLA

SEQ ID NO: 2009 - protein, 10 aa, Artificial Sequence
  synthetic polypeptide
LLIYATTSRH

SEQ ID NO: 2010 - protein, 10 aa, Artificial Sequence
  synthetic polypeptide
LLIYAATSRA

SEQ ID NO: 2011 - protein, 10 aa, Artificial Sequence
  synthetic polypeptide
LLIYAATSRA

SEQ ID NO: 2012 - protein, 10 aa, Artificial Sequence
  synthetic polypeptide
LVIYAATSRH

SEQ ID NO: 2013 - protein, 10 aa, Artificial Sequence
  synthetic polypeptide
LLIYAATSRA

SEQ ID NO: 2014 - protein, 10 aa, Artificial Sequence
  synthetic polypeptide
LLIYAASSLQ

SEQ ID NO: 2015 - protein, 10 aa, Artificial Sequence
  synthetic polypeptide
LVIYAATSLA

SEQ ID NO: 2016 - protein, 10 aa, Artificial Sequence
  synthetic polypeptide
LLIYAATSRA

SEQ ID NO: 2017 - protein, 10 aa, Artificial Sequence
  synthetic polypeptide
LLIYAATSLA

SEQ ID NO: 2018 - protein, 10 aa, Artificial Sequence
  synthetic polypeptide
LLIYAATSRA

SEQ ID NO: 2019 - protein, 10 aa, Artificial Sequence
  synthetic polypeptide
LVIYAATSRA

SEQ ID NO: 2020 - protein, 10 aa, Artificial Sequence
  synthetic polypeptide
LVIYAATSLA

SEQ ID NO: 2021 - protein, 10 aa, Artificial Sequence
  synthetic polypeptide
LLIYAATSLA

SEQ ID NO: 2022 - protein, 10 aa, Artificial Sequence
  synthetic polypeptide
LVIYAATSRH

SEQ ID NO: 2023 - protein, 10 aa, Artificial Sequence
  synthetic polypeptide
LLIYAATSLA

SEQ ID NO: 2024 - protein, 10 aa, Artificial Sequence
  synthetic polypeptide
LLIYAATSRA

SEQ ID NO: 2025 - protein, 10 aa, Artificial Sequence
  synthetic polypeptide
LVIYAATSRA

SEQ ID NO: 2026 - protein, 10 aa, Artificial Sequence
  synthetic polypeptide
LLIYAATSRH

SEQ ID NO: 2027 - protein, 10 aa, Artificial Sequence
  synthetic polypeptide
LLIYAATSRA

SEQ ID NO: 2028 - protein, 10 aa, Artificial Sequence
  synthetic polypeptide
LLIYAASSLQ

SEQ ID NO: 2029 - protein, 10 aa, Artificial Sequence
  synthetic polypeptide
LLIYAATSRH

SEQ ID NO: 2030 - protein, 10 aa, Artificial Sequence
  synthetic polypeptide
LVIYAATSRA

SEQ ID NO: 2031 - protein, 10 aa, Artificial Sequence
  synthetic polypeptide
LLIYAATSLA

SEQ ID NO: 2032 - protein, 10 aa, Artificial Sequence
  synthetic polypeptide
LLIYAATSRA

SEQ ID NO: 2033 - protein, 10 aa, Artificial Sequence
  synthetic polypeptide
LLIYAATSRA

SEQ ID NO: 2034 - protein, 10 aa, Artificial Sequence
  synthetic polypeptide
LLIYAATSRA

SEQ ID NO: 2035 - protein, 8 aa, Artificial Sequence
  synthetic polypeptide
QQSDNTPL

SEQ ID NO: 2036 - protein, 8 aa, Artificial Sequence
  synthetic polypeptide
QQSYDLPL

SEQ ID NO: 2037 - protein, 8 aa, Artificial Sequence
  synthetic polypeptide
QQSYENPL

SEQ ID NO: 2038 - protein, 8 aa, Artificial Sequence
  synthetic polypeptide
QQSYDTPL

SEQ ID NO: 2039 - protein, 8 aa, Artificial Sequence
  synthetic polypeptide
QQSYDNPL

SEQ ID NO: 2040 - protein, 8 aa, Artificial Sequence
  synthetic polypeptide
QQSYSTPL

SEQ ID NO: 2041 - protein, 8 aa, Artificial Sequence
  synthetic polypeptide
QQSYESPL

SEQ ID NO: 2042 - protein, 8 aa, Artificial Sequence
  synthetic polypeptide
QQSYNTPL

SEQ ID NO: 2043 - protein, 8 aa, Artificial Sequence
  synthetic polypeptide
QQSYETPL

SEQ ID NO: 2044 - protein, 8 aa, Artificial Sequence
  synthetic polypeptide
QQSYSTPL

SEQ ID NO: 2045 - protein, 8 aa, Artificial Sequence
  synthetic polypeptide
QQSYENPL

SEQ ID NO: 2046 - protein, 8 aa, Artificial Sequence
  synthetic polypeptide
QQSYSTPL

SEQ ID NO: 2047 - protein, 8 aa, Artificial Sequence
  synthetic polypeptide
QQSYDLPL

SEQ ID NO: 2048 - protein, 8 aa, Artificial Sequence
  synthetic polypeptide
QQSYDTPL

SEQ ID NO: 2049 - protein, 8 aa, Artificial Sequence
  synthetic polypeptide
QQSYNSPL

SEQ ID NO: 2050 - protein, 8 aa, Artificial Sequence
  synthetic polypeptide
QQSDSNPL

SEQ ID NO: 2051 - protein, 8 aa, Artificial Sequence
  synthetic polypeptide
QQSYDSPL

SEQ ID NO: 2052 - protein, 8 aa, Artificial Sequence
  synthetic polypeptide
QQSYDNPL

SEQ ID NO: 2053 - protein, 8 aa, Artificial Sequence
  synthetic polypeptide
QQSYENPL

SEQ ID NO: 2054 - protein, 8 aa, Artificial Sequence
  synthetic polypeptide
QQSYNSPL

SEQ ID NO: 2055 - protein, 8 aa, Artificial Sequence
  synthetic polypeptide
QQSDSNPL

SEQ ID NO: 2056 - protein, 8 aa, Artificial Sequence
  synthetic polypeptide
QQSYSTPL

SEQ ID NO: 2057 - protein, 8 aa, Artificial Sequence
  synthetic polypeptide
QQSYELPL

SEQ ID NO: 2058 - protein, 8 aa, Artificial Sequence
  synthetic polypeptide
QQSYSTPL

SEQ ID NO: 2059 - protein, 8 aa, Artificial Sequence
  synthetic polypeptide
QQSYDNPL

SEQ ID NO: 2060 - protein, 8 aa, Artificial Sequence
  synthetic polypeptide
QQSYDTPL

SEQ ID NO: 2061 - protein, 8 aa, Artificial Sequence
  synthetic polypeptide
QQSYNNPL

SEQ ID NO: 2062 - protein, 8 aa, Artificial Sequence
  synthetic polypeptide
QQSYENPL

SEQ ID NO: 2063 - protein, 8 aa, Artificial Sequence
  synthetic polypeptide
QQSYDTPL

SEQ ID NO: 2064 - protein, 8 aa, Artificial Sequence
  synthetic polypeptide
QQSYDTPL

SEQ ID NO: 2065 - protein, 8 aa, Artificial Sequence
  synthetic polypeptide
QQSYDNPL

SEQ ID NO: 2066 - protein, 8 aa, Artificial Sequence
  synthetic polypeptide
QQSDDTPL

SEQ ID NO: 2067 - protein, 8 aa, Artificial Sequence
  synthetic polypeptide
QQSYESPL

SEQ ID NO: 2068 - protein, 8 aa, Artificial Sequence
  synthetic polypeptide
QQSYDTPL

SEQ ID NO: 2069 - protein, 8 aa, Artificial Sequence
  synthetic polypeptide
QQSYDTPL

SEQ ID NO: 2070 - protein, 8 aa, Artificial Sequence
  synthetic polypeptide
QQSYETPL

SEQ ID NO: 2071 - protein, 8 aa, Artificial Sequence
  synthetic polypeptide
QQSYDSPL

SEQ ID NO: 2072 - protein, 8 aa, Artificial Sequence
  synthetic polypeptide
QQGYDSPL

SEQ ID NO: 2073 - protein, 8 aa, Artificial Sequence
  synthetic polypeptide
QQSYDSPL

SEQ ID NO: 2074 - protein, 8 aa, Artificial Sequence
  synthetic polypeptide
QQSYDSPL

SEQ ID NO: 2075 - protein, 8 aa, Artificial Sequence
  synthetic polypeptide
QQSYDSPL

SEQ ID NO: 2076 - protein, 8 aa, Artificial Sequence
  synthetic polypeptide
QQSYESPL

SEQ ID NO: 2077 - protein, 8 aa, Artificial Sequence
  synthetic polypeptide
QQSYDSPL

SEQ ID NO: 2078 - protein, 8 aa, Artificial Sequence
  synthetic polypeptide
QQSYDSPL

SEQ ID NO: 2079 - protein, 8 aa, Artificial Sequence
  synthetic polypeptide
QQSYSTPL

SEQ ID NO: 2080 - protein, 8 aa, Artificial Sequence
  synthetic polypeptide
QQSYESPL

SEQ ID NO: 2081 - protein, 8 aa, Artificial Sequence
  synthetic polypeptide
QQSYSSPL

SEQ ID NO: 2082 - protein, 8 aa, Artificial Sequence
  synthetic polypeptide
QQSYDLPL

SEQ ID NO: 2083 - protein, 8 aa, Artificial Sequence
  synthetic polypeptide
QQSYDTPL

SEQ ID NO: 2084 - protein, 8 aa, Artificial Sequence
  synthetic polypeptide
QQSYETPL

SEQ ID NO: 2085 - protein, 8 aa, Artificial Sequence
  synthetic polypeptide
QQSYNSPL

SEQ ID NO: 2086 - protein, 8 aa, Artificial Sequence
  synthetic polypeptide
QQSYDSPL

SEQ ID NO: 2087 - protein, 8 aa, Artificial Sequence
  synthetic polypeptide
QQSYDSPL

SEQ ID NO: 2088 - protein, 8 aa, Artificial Sequence
  synthetic polypeptide
QQSYDSPL

SEQ ID NO: 2089 - protein, 8 aa, Artificial Sequence
  synthetic polypeptide
QQSYESPL

SEQ ID NO: 2090 - protein, 8 aa, Artificial Sequence
  synthetic polypeptide
QQSYDLPL

SEQ ID NO: 2091 - protein, 8 aa, Artificial Sequence
  synthetic polypeptide
QQSYETPL

SEQ ID NO: 2092 - protein, 8 aa, Artificial Sequence
  synthetic polypeptide
QQSYDLPL

SEQ ID NO: 2093 - protein, 8 aa, Artificial Sequence
  synthetic polypeptide
QQSYDLPL

SEQ ID NO: 2094 - protein, 8 aa, Artificial Sequence
  synthetic polypeptide
QQSYDTPL

SEQ ID NO: 2095 - protein, 8 aa, Artificial Sequence
  synthetic polypeptide
QQSYSSPL

SEQ ID NO: 2096 - protein, 8 aa, Artificial Sequence
  synthetic polypeptide
QQSYDLPL

SEQ ID NO: 2097 - protein, 8 aa, Artificial Sequence
  synthetic polypeptide
QQSYNSPL

SEQ ID NO: 2098 - protein, 8 aa, Artificial Sequence
  synthetic polypeptide
QQSYDTPL

SEQ ID NO: 2099 - protein, 8 aa, Artificial Sequence
  synthetic polypeptide
QQSYDNPL

SEQ ID NO: 2100 - protein, 8 aa, Artificial Sequence
  synthetic polypeptide
QQSYDNPL

SEQ ID NO: 2101 - protein, 8 aa, Artificial Sequence
  synthetic polypeptide
QQSYDLPL

SEQ ID NO: 2102 - protein, 8 aa, Artificial Sequence
  synthetic polypeptide
QQSYESPL

SEQ ID NO: 2103 - protein, 8 aa, Artificial Sequence
  synthetic polypeptide
QQSYETPL

SEQ ID NO: 2104 - protein, 8 aa, Artificial Sequence
  synthetic polypeptide
QQSYNLPL

SEQ ID NO: 2105 - protein, 8 aa, Artificial Sequence
  synthetic polypeptide
QQSYDLPL

SEQ ID NO: 2106 - protein, 8 aa, Artificial Sequence
  synthetic polypeptide
QQSYENPL

SEQ ID NO: 2107 - protein, 8 aa, Artificial Sequence
  synthetic polypeptide
QQSYSTPL

SEQ ID NO: 2108 - protein, 8 aa, Artificial Sequence
  synthetic polypeptide
QQSYETPL

SEQ ID NO: 2109 - protein, 8 aa, Artificial Sequence
  synthetic polypeptide
QQSYDTPL

SEQ ID NO: 2110 - protein, 8 aa, Artificial Sequence
  synthetic polypeptide
QQSYETPL

SEQ ID NO: 2111 - protein, 8 aa, Artificial Sequence
  synthetic polypeptide
QQSYSSPL

SEQ ID NO: 2112 - protein, 8 aa, Artificial Sequence
  synthetic polypeptide
QQSYDTPL

SEQ ID NO: 2113 - protein, 8 aa, Artificial Sequence
  synthetic polypeptide
QQSYELPL

SEQ ID NO: 2114 - protein, 8 aa, Artificial Sequence
  synthetic polypeptide
QQSYNTPL

SEQ ID NO: 2115 - protein, 8 aa, Artificial Sequence
  synthetic polypeptide
QQSYDTPL

SEQ ID NO: 2116 - protein, 8 aa, Artificial Sequence
  synthetic polypeptide
QQSYDTPL

SEQ ID NO: 2117 - protein, 8 aa, Artificial Sequence
  synthetic polypeptide
QQSYDLPL

SEQ ID NO: 2118 - protein, 8 aa, Artificial Sequence
  synthetic polypeptide
QQSYDNPL

SEQ ID NO: 2119 - protein, 8 aa, Artificial Sequence
  synthetic polypeptide
QQSYDNPL

SEQ ID NO: 2120 - protein, 8 aa, Artificial Sequence
  synthetic polypeptide
QQSYDSPL

SEQ ID NO: 2121 - protein, 8 aa, Artificial Sequence
  synthetic polypeptide
QQSYSTPL

SEQ ID NO: 2122 - protein, 8 aa, Artificial Sequence
  synthetic polypeptide
QQSYDTPL

SEQ ID NO: 2123 - protein, 8 aa, Artificial Sequence
  synthetic polypeptide
QQSYDTPL

SEQ ID NO: 2124 - protein, 8 aa, Artificial Sequence
  synthetic polypeptide
QQSYDSPL

SEQ ID NO: 2125 - protein, 8 aa, Artificial Sequence
  synthetic polypeptide
QQSYDLPL

SEQ ID NO: 2126 - protein, 8 aa, Artificial Sequence
  synthetic polypeptide
QQSYNTPL

SEQ ID NO: 2127 - protein, 8 aa, Artificial Sequence
  synthetic polypeptide
QQSYDSPL

SEQ ID NO: 2128 - protein, 120 aa, Artificial Sequence
  synthetic polypeptide
EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCARSANWHDTALDYWGQGTLVTVSS

SEQ ID NO: 2129 - protein, 120 aa, Artificial Sequence
  synthetic polypeptide
EVQLLESGGGLVQPGGSLRLSCAASGFTFDDYGMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2130 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCAKSANWHDTHLDYWGQGTLVTVSS

SEQ ID NO: 2131 - protein, 120 aa, Artificial Sequence
  synthetic polypeptide
EVQLLESGGGLVQPGGSLRLSCAASGFTFDSYGMHWVRQAPGKGLEWVASINYNSGYTSYADSVKGRFTISRDNSKNTLYLQMNSLRAEDTAVYYCARSANWHDTALDYWGQGTLVTVSS

SEQ ID NO: 2132 - protein, 120 aa, Artificial Sequence
  synthetic polypeptide
EVQLLESGGGLVQPGGSLRLSCAASGFTFDSYGMHWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2133 - protein, 120 aa, Artificial Sequence
  synthetic polypeptide
EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARSANWHDTALDYWGQGTLVTVSS

SEQ ID NO: 2134 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2135 - protein, 120 aa, Artificial Sequence
  synthetic polypeptide
EVQLLESGGGLVQPGGSLRLSCAASGFTFDSYGMNWVRQAPGKGLEWVSSINYNSGYKSYADSVKGRFTISRDNSKNTLYLQMNSLRAEDTAVYYCARSANWHDTHLDYWGQGTLVTVSS

SEQ ID NO: 2136 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARSANWHDTALDYWGQGTLVTVSS

SEQ ID NO: 2137 - protein, 120 aa, Artificial Sequence
  synthetic polypeptide
EVQLLESGGGLVQPGGSLRLSCAASGFTFSSYSMNWVRQAPGKGLEWVAGINYNGGYKSYADSVKGRFTISRDNSKNTLYLQMNSLRAEDTAVYYCARSANWHDTHLDYWGQGTLVTVSS

SEQ ID NO: 2138 - protein, 120 aa, Artificial Sequence
  synthetic polypeptide
EVQLLESGGGLVQPGGSLRLSCAASGFTFSSYGMNWVRQAPGKGLEWVAGINYNSGYKSYADSVKGRFTISRDNSKNTLYLQMNSLRAEDTAVYYCARSANWHDTALDYWGQGTLVTVSS

SEQ ID NO: 2139 - protein, 120 aa, Artificial Sequence
  synthetic polypeptide
EVQLLESGGGLVQPGGSLRLSCAASGFTFSSYGMHWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2140 - protein, 120 aa, Artificial Sequence
  synthetic polypeptide
EVQLLESGGGLVQPGGSLRLSCAASGFTFDSYGMNWVRQAPGKGLEWVSNINYNSGYTSYADSVKGRFTISRDNSKNTLYLQMNSLRAEDTAVYYCARSANWHDTALDYWGQGTLVTVSS

SEQ ID NO: 2141 - protein, 120 aa, Artificial Sequence
  synthetic polypeptide
EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSANWHDTALDYWGQGTLVTVSS

SEQ ID NO: 2142 - protein, 120 aa, Artificial Sequence
  synthetic polypeptide
EVQLLESGGGLVQPGGSLRLSCAASGFTFSDYSMNWVRQAPGKGLEWVSGINYNSGYKGYADSVKGRFTISRDNSKNTLYLQMNSLRAEDTAVYYCARSANWHDTALDYWGQGTLVTVSS

SEQ ID NO: 2143 - protein, 120 aa, Artificial Sequence; identical to SEQ ID NO: 2134
  synthetic polypeptide

SEQ ID NO: 2144 - protein, 120 aa, Artificial Sequence
  synthetic polypeptide
EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCAKSANWHDTHLDYWGQGTLVTVSS

SEQ ID NO: 2145 - protein, 120 aa, Artificial Sequence
  synthetic polypeptide
EVQLLESGGGLVQPGGSLRLSCAASGFTFSSYGMHWVRQAPGKGLEWVASINYNSGYKSYADSVKGRFTISRDNSKNTLYLQMNSLRAEDTAVYYCARSANWHDTALDYWGQGTLVTVSS

SEQ ID NO: 2146 - protein, 120 aa, Artificial Sequence
  synthetic polypeptide
EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSANWHDTHLDYWGQGTLVTVSS

SEQ ID NO: 2147 - protein, 120 aa, Artificial Sequence; identical to SEQ ID NO: 2138
  synthetic polypeptide

SEQ ID NO: 2148 - protein, 120 aa, Artificial Sequence
  synthetic polypeptide
EVQLLESGGGLVQPGGSLRLSCAASGFTFSDYSMNWVRQAPGKGLEWVSGINYNGGYTSYADSVKGRFTISRDNSKNTLYLQMNSLRAEDTAVYYCARSANWHDTHLDYWGQGTLVTVSS

SEQ ID NO: 2149 - protein, 120 aa, Artificial Sequence
  synthetic polypeptide
EVQLLESGGGLVQPGGSLRLSCAASGFTFDSYGMNWVRQAPGKGLEWVAGINYNSGYKSYADSVKGRFTISRDNSKNTLYLQMNSLRAEDTAVYYCARSANWHDTALDYWGQGTLVTVSS

SEQ ID NO: 2150 - protein, 120 aa, Artificial Sequence
  synthetic polypeptide
EVQLLESGGGLVQPGGSLRLSCAASGFTFSSYGMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2151 - protein, 120 aa, Artificial Sequence
  synthetic polypeptide
EVQLLESGGGLVQPGGSLRLSCAASGFTFSDYGMNWVRQAPGKGLEWVSSINYNGGYTGYADSVKGRFTISRDNSKNTLYLQMNSLRAEDTAVYYCARSANWHDTHLDYWGQGTLVTVSS

SEQ ID NO: 2152 - protein, 120 aa, Artificial Sequence
  synthetic polypeptide
EVQLLESGGGLVQPGGSLRLSCAASGFTFDDYGMNWVRQAPGKGLEWVAGINYNGGYKSYADSVKGRFTISRDNSKNTLYLQMNSLRAEDTAVYYCARSANWHDTALDYWGQGTLVTVSS

SEQ ID NO: 2153 - protein, 120 aa, Artificial Sequence
  synthetic polypeptide
EVQLLESGGGLVQPGGSLRLSCAASGFTFSSYGMNWVRQAPGKGLEWVSGINYNSGYTGYADSVKGRFTISRDNSKNTLYLQMNSLRAEDTAVYYCARSANWHDTALDYWGQGTLVTVSS

SEQ ID NO: 2154 - protein, 120 aa, Artificial Sequence
  synthetic polypeptide
EVQLLESGGGLVQPGGSLRLSCAASGFTFDSYGMNWVRQAPGKGLEWVAGINYNSGYKSYADSVKGRFTISRDNSKNTLYLQMNSLRAEDTAVYYCARSANWHDTHLDYWGQGTLVTVSS

SEQ ID NO: 2155 - protein, 120 aa, Artificial Sequence
  synthetic polypeptide
EVQLLESGGGLVQPGGSLRLSCAASGFTFSSYSMNWVRQAPGKGLEWVSGINYNSGYTGYADSVKGRFTISRDNSKNTLYLQMNSLRAEDTAVYYCARSANWHDTALDYWGQGTLVTVSS

SEQ ID NO: 2156 - protein, 120 aa, Artificial Sequence
  synthetic polypeptide
EVQLLESGGGLVQPGGSLRLSCAASGFTFSSYSMNWVRQAPGKGLEWVSNINYNGGYKSYADSVKGRFTISRDNSKNTLYLQMNSLRAEDTAVYYCARSANWHDTHLDYWGQGTLVTVSS

SEQ ID NO: 2157 - protein, 120 aa, Artificial Sequence
  synthetic polypeptide
EVQLLESGGGLVQPGGSLRLSCAASGFTFSSYGMHWVRQAPGKGLEWVASINYNGGYTGYADSVKGRFTISRDNSKNTLYLQMNSLRAEDTAVYYCARSANWHDTALDYWGQGTLVTVSS

SEQ ID NO: 2158 - protein, 120 aa, Artificial Sequence
  synthetic polypeptide
EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARSANWHDTHLDYWGQGTLVTVSS

SEQ ID NO: 2159 - protein, 120 aa, Artificial Sequence
  synthetic polypeptide
EVQLLESGGGLVQPGGSLRLSCAASGFTFSSYGMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2160 - protein, 120 aa, Artificial Sequence; identical to SEQ ID NO: 2128
  synthetic polypeptide

SEQ ID NO: 2161 - protein, 120 aa, Artificial Sequence
  synthetic polypeptide
EVQLLESGGGLVQPGGSLRLSCAASGFTFSSYSMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2162 - protein, 120 aa, Artificial Sequence
  synthetic polypeptide
EVQLLESGGGLVQPGGSLRLSCAASGFTFDSYGMNWVRQAPGKGLEWVSGINYNGGYKGYADSVKGRFTISRDNSKNTLYLQMNSLRAEDTAVYYCARSANWHDTHLDYWGQGTLVTVSS

SEQ ID NO: 2163 - protein, 120 aa, Artificial Sequence
  synthetic polypeptide
EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2164 - protein, 120 aa, Artificial Sequence
  synthetic polypeptide
EVQLLESGGGLVQPGGSLRLSCAASGFTFSSYSMNWVRQAPGKGLEWVANINYNSGYKSYADSVKGRFTISRDNSKNTLYLQMNSLRAEDTAVYYCARSANWHDTHLDYWGQGTLVTVSS

SEQ ID NO: 2165 - protein, 120 aa, Artificial Sequence
  synthetic polypeptide
EVQLLESGGGLVQPGGSLRLSCAASGFTFSDYSMNWVRQAPGKGLEWVAGINYNSGYTSYADSVKGRFTISRDNSKNTLYLQMNSLRAEDTAVYYCARSANWHDTHLDYWGQGTLVTVSS

SEQ ID NO: 2166 - protein, 120 aa, Artificial Sequence
  synthetic polypeptide
EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2167 - protein, 120 aa, Artificial Sequence
  synthetic polypeptide
EVQLLESGGGLVQPGGSLRLSCAASGFTFDSYGMNWVRQAPGKGLEWVSNINYNGGYTSYADSVKGRFTISRDNSKNTLYLQMNSLRAEDTAVYYCARSANWHDTALDYWGQGTLVTVSS

SEQ ID NO: 2168 - protein, 120 aa, Artificial Sequence
  synthetic polypeptide
EVQLLESGGGLVQPGGSLRLSCAASGFTFSSYGMNWVRQAPGKGLEWVSSINYNGGYTGYADSVKGRFTISRDNSKNTLYLQMNSLRAEDTAVYYCARSANWHDTALDYWGQGTLVTVSS

SEQ ID NO: 2169 - protein, 120 aa, Artificial Sequence
  synthetic polypeptide
EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2170 - protein, 120 aa, Artificial Sequence
  synthetic polypeptide
EVQLLESGGGLVQPGGSLRLSCAASGFTFSDYGMNWVRQAPGKGLEWVASINYNSGYTSYADSVKGRFTISRDNSKNTLYLQMNSLRAEDTAVYYCARSANWHDTHLDYWGQGTLVTVSS

SEQ ID NO: 2171 - protein, 120 aa, Artificial Sequence
  synthetic polypeptide
EVQLLESGGGLVQPGGSLRLSCAASGFTFDSYGMNWVRQAPGKGLEWVSNINYNSGYKGYADSVKGRFTISRDNSKNTLYLQMNSLRAEDTAVYYCARSANWHDTALDYWGQGTLVTVSS

SEQ ID NO: 2172 - protein, 120 aa, Artificial Sequence
  synthetic polypeptide
EVQLLESGGGLVQPGGSLRLSCAASGFTFSSYSMNWVRQAPGKGLEWVSNINYNSGYKSYADSVKGRFTISRDNSKNTLYLQMNSLRAEDTAVYYCARSANWHDTALDYWGQGTLVTVSS

SEQ ID NO: 2173 - protein, 120 aa, Artificial Sequence
  synthetic polypeptide
EVQLLESGGGLVQPGGSLRLSCAASGFTFSDYGMNWVRQAPGKGLEWVSSINYNGGYKGYADSVKGRFTISRDNSKNTLYLQMNSLRAEDTAVYYCARSANWHDTALDYWGQGTLVTVSS

SEQ ID NO: 2174 - protein, 120 aa, Artificial Sequence
  synthetic polypeptide
EVQLLESGGGLVQPGGSLRLSCAASGFTFDSYGMNWVRQAPGKGLEWVSSINYNGGYTSYADSVKGRFTISRDNSKNTLYLQMNSLRAEDTAVYYCARSANWHDTALDYWGQGTLVTVSS

SEQ ID NO: 2175 - protein, 120 aa, Artificial Sequence
  synthetic polypeptide
EVQLLESGGGLVQPGGSLRLSCAASGFTFSSYGMNWVRQAPGKGLEWVAGINYNGGYKSYADSVKGRFTISRDNSKNTLYLQMNSLRAEDTAVYYCARSANWHDTALDYWGQGTLVTVSS

SEQ ID NO: 2176 - protein, 120 aa, Artificial Sequence
  synthetic polypeptide
EVQLLESGGGLVQPGGSLRLSCAASGFTFSDYSMNWVRQAPGKGLEWVAGINYNSGYTGYADSVKGRFTISRDNSKNTLYLQMNSLRAEDTAVYYCARSANWHDTHLDYWGQGTLVTVSS

SEQ ID NO: 2177 - protein, 120 aa, Artificial Sequence
  synthetic polypeptide
EVQLLESGGGLVQPGGSLRLSCAASGFTFSDYGMNWVRQAPGKGLEWVSGINYNGGYKGYADSVKGRFTISRDNSKNTLYLQMNSLRAEDTAVYYCARSANWHDTALDYWGQGTLVTVSS

SEQ ID NO: 2178 - protein, 120 aa, Artificial Sequence
  synthetic polypeptide
EVQLLESGGGLVQPGGSLRLSCAASGFTFDDYSMNWVRQAPGKGLEWVSGINYNGGYKSYADSVKGRFTISRDNSKNTLYLQMNSLRAEDTAVYYCARSANWHDTHLDYWGQGTLVTVSS

SEQ ID NO: 2179 - protein, 120 aa, Artificial Sequence
  synthetic polypeptide
EVQLLESGGGLVQPGGSLRLSCAASGFTFDDYGMNWVRQAPGKGLEWVSSINYNGGYTGYADSVKGRFTISRDNSKNTLYLQMNSLRAEDTAVYYCARSANWHDTHLDYWGQGTLVTVSS

SEQ ID NO: 2180 - protein, 120 aa, Artificial Sequence
  synthetic polypeptide
EVQLLESGGGLVQPGGSLRLSCAASGFTFDSYSMNWVRQAPGKGLEWVSSINYNSGYTGYADSVKGRFTISRDNSKNTLYLQMNSLRAEDTAVYYCARSANWHDTHLDYWGQGTLVTVSS

SEQ ID NO: 2181 - protein, 120 aa, Artificial Sequence; identical to SEQ ID NO: 2167
  synthetic polypeptide

SEQ ID NO: 2182 - protein, 120 aa, Artificial Sequence; identical to SEQ ID NO: 2175
  synthetic polypeptide

SEQ ID NO: 2183 - protein, 120 aa, Artificial Sequence
  synthetic polypeptide
EVQLLESGGGLVQPGGSLRLSCAASGFTFSDYSMNWVRQAPGKGLEWVSSINYNGGYKGYADSVKGRFTISRDNSKNTLYLQMNSLRAEDTAVYYCARSANWHDTHLDYWGQGTLVTVSS

SEQ ID NO: 2184 - protein, 120 aa, Artificial Sequence
  synthetic polypeptide
EVQLLESGGGLVQPGGSLRLSCAASGFTFDSYSMNWVRQAPGKGLEWVSSINYNSGYKGYADSVKGRFTISRDNSKNTLYLQMNSLRAEDTAVYYCARSANWHDTHLDYWGQGTLVTVSS

SEQ ID NO: 2185 - protein, 120 aa, Artificial Sequence
  synthetic polypeptide
EVQLLESGGGLVQPGGSLRLSCAASGFTFSDYGMNWVRQAPGKGLEWVASINYNSGYKGYADSVKGRFTISRDNSKNTLYLQMNSLRAEDTAVYYCARSANWHDTALDYWGQGTLVTVSS

SEQ ID NO: 2186 - protein, 120 aa, Artificial Sequence
  synthetic polypeptide
EVQLLESGGGLVQPGGSLRLSCAASGFTFDSYGMNWVRQAPGKGLEWVSSINYNSGYKGYADSVKGRFTISRDNSKNTLYLQMNSLRAEDTAVYYCARSANWHDTHLDYWGQGTLVTVSS

SEQ ID NO: 2187 - protein, 120 aa, Artificial Sequence
  synthetic polypeptide
EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSANWHDTALDYWGQGTLVTVSS

SEQ ID NO: 2188 - protein, 120 aa, Artificial Sequence
  synthetic polypeptide
EVQLLESGGGLVQPGGSLRLSCAASGFTFDSYGMHWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2189 - protein, 120 aa, Artificial Sequence
  synthetic polypeptide
EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARSANWHDTHLDYWGQGTLVTVSS

SEQ ID NO: 2190 - protein, 120 aa, Artificial Sequence
  synthetic polypeptide
EVQLLESGGGLVQPGGSLRLSCAASGFTFSDYGMNWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2191 - protein, 120 aa, Artificial Sequence
  synthetic polypeptide
EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARSANWHDTHLDYWGQGTLVTVSS

SEQ ID NO: 2192 - protein, 120 aa, Artificial Sequence
  synthetic polypeptide
EVQLLESGGGLVQPGGSLRLSCAASGFTFDDYGMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2193 - protein, 120 aa, Artificial Sequence
  synthetic polypeptide
EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARSANWHDTHLDYWGQGTLVTVSS

SEQ ID NO: 2194 - protein, 120 aa, Artificial Sequence
  synthetic polypeptide
EVQLLESGGGLVQPGGSLRLSCAASGFTFSSYGMNWVRQAPGKGLEWVAGINYNGGYKGYADSVKGRFTISRDNSKNTLYLQMNSLRAEDTAVYYCARSANWHDTALDYWGQGTLVTVSS

SEQ ID NO: 2195 - protein, 120 aa, Artificial Sequence
  synthetic polypeptide
EVQLLESGGGLVQPGGSLRLSCAASGFTFSSYGMNWVRQAPGKGLEWVSNINYNGGYTSYADSVKGRFTISRDNSKNTLYLQMNSLRAEDTAVYYCARSANWHDTALDYWGQGTLVTVSS

SEQ ID NO: 2196 - protein, 120 aa, Artificial Sequence
  synthetic polypeptide
EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARSANWHDTALDYWGQGTLVTVSS

SEQ ID NO: 2197 - protein, 120 aa, Artificial Sequence
  synthetic polypeptide
EVQLLESGGGLVQPGGSLRLSCAASGFTFSSYSMNWVRQAPGKGLEWVAGINYNSGYTSYADSVKGRFTISRDNSKNTLYLQMNSLRAEDTAVYYCARSANWHDTHLDYWGQGTLVTVSS

SEQ ID NO: 2198 - protein, 120 aa, Artificial Sequence
  synthetic polypeptide
EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARSANWHDTHLDYWGQGTLVTVSS

SEQ ID NO: 2199 - protein, 120 aa, Artificial Sequence
  synthetic polypeptide
EVQLLESGGGLVQPGGSLRLSCAASGFTFSSYGMNWVRQAPGKGLEWVSGINYNSGYKSYADSVKGRFTISRDNSKNTLYLQMNSLRAEDTAVYYCARSANWHDTALDYWGQGTLVTVSS

SEQ ID NO: 2200 - protein, 120 aa, Artificial Sequence
  synthetic polypeptide
EVQLLESGGGLVQPGGSLRLSCAASGFTFDSYGMHWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2201 - protein, 120 aa, Artificial Sequence
  synthetic polypeptide
EVQLLESGGGLVQPGGSLRLSCAASGFTFSDYSMNWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2202 - protein, 120 aa, Artificial Sequence
  synthetic polypeptide
EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2203 - protein, 120 aa, Artificial Sequence
  synthetic polypeptide
EVQLLESGGGLVQPGGSLRLSCAASGFTFSSYGMHWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2204 - protein, 120 aa, Artificial Sequence
  synthetic polypeptide
EVQLLESGGGLVQPGGSLRLSCAASGFTFSSYGMNWVRQAPGKGLEWVSGINYNGGYKSYADSVKGRFTISRDNSKNTLYLQMNSLRAEDTAVYYCARSANWHDTALDYWGQGTLVTVSS

SEQ ID NO: 2205 - protein, 120 aa, Artificial Sequence; identical to SEQ ID NO: 2161
  synthetic polypeptide

SEQ ID NO: 2206 - protein, 120 aa, Artificial Sequence
  synthetic polypeptide
EVQLLESGGGLVQPGGSLRLSCAASGFTFDDYGMNWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2207 - protein, 120 aa, Artificial Sequence
  synthetic polypeptide
EVQLLESGGGLVQPGGSLRLSCAASGFTFSSYSMNWVRQAPGKGLEWVASINYNSGYTGYADSVKGRFTISRDNSKNTLYLQMNSLRAEDTAVYYCARSANWHDTHLDYWGQGTLVTVSS

SEQ ID NO: 2208 - protein, 120 aa, Artificial Sequence
  synthetic polypeptide
EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSANWHDTHLDYWGQGTLVTVSS

SEQ ID NO: 2209 - protein, 120 aa, Artificial Sequence
  synthetic polypeptide
EVQLLESGGGLVQPGGSLRLSCAASGFTFSSYSMNWVRQAPGKGLEWVANINYNSGYTGYADSVKGRFTISRDNSKNTLYLQMNSLRAEDTAVYYCARSANWHDTALDYWGQGTLVTVSS

SEQ ID NO: 2210 - protein, 120 aa, Artificial Sequence
  synthetic polypeptide
EVQLLESGGGLVQPGGSLRLSCAASGFTFSDYGMHWVRQAPGKGLEWVSGINYNGGYTGYADSVKGRFTISRDNSKNTLYLQMNSLRAEDTAVYYCARSANWHDTALDYWGQGTLVTVSS

SEQ ID NO: 2211 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCAKSANWHDTALDYWGQGTLVTVSS

SEQ ID NO: 2212 - protein, 120 aa, Artificial Sequence
  synthetic polypeptide
EVQLLESGGGLVQPGGSLRLSCAASGFTFDSYSMNWVRQAPGKGLEWVAGINYNSGYTGYADSVKGRFTISRDNSKNTLYLQMNSLRAEDTAVYYCAKSANWHDTALDYWGQGTLVTVSS

SEQ ID NO: 2213 - protein, 120 aa, Artificial Sequence
  synthetic polypeptide
EVQLLESGGGLVQPGGSLRLSCAASGFTFSDYGMNWVRQAPGKGLEWVSGINYNGGYTSYADSVKGRFTISRDNSKNTLYLQMNSLRAEDTAVYYCARSANWHDTHLDYWGQGTLVTVSS

SEQ ID NO: 2214 - protein, 120 aa, Artificial Sequence
  synthetic polypeptide
EVQLLESGGGLVQPGGSLRLSCAASGFTFSDYGMHWVRQAPGKGLEWVASINYNSGYTSYADSVKGRFTISRDNSKNTLYLQMNSLRAEDTAVYYCARSANWHDTALDYWGQGTLVTVSS

SEQ ID NO: 2215 - protein, 120 aa, Artificial Sequence
  synthetic polypeptide
EVQLLESGGGLVQPGGSLRLSCAASGFTFSSYGMNWVRQAPGKGLEWVASINYNSGYTGYADSVKGRFTISRDNSKNTLYLQMNSLRAEDTAVYYCARSANWHDTALDYWGQGTLVTVSS

SEQ ID NO: 2216 - protein, 120 aa, Artificial Sequence
  synthetic polypeptide
EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCAKSANWHDTHLDYWGQGTLVTVSS

SEQ ID NO: 2217 - protein, 120 aa, Artificial Sequence; identical to SEQ ID NO: 2189
  synthetic polypeptide

SEQ ID NO: 2218 - protein, 120 aa, Artificial Sequence
  synthetic polypeptide
EVQLLESGGGLVQPGGSLRLSCAASGFTFSSYGMNWVRQAPGKGLEWVSNINYNGGYTGYADSVKGRFTISRDNSKNTLYLQMNSLRAEDTAVYYCARSANWHDTALDYWGQGTLVTVSS

SEQ ID NO: 2219 - protein, 120 aa, Artificial Sequence; identical to SEQ ID NO: 2161
  synthetic polypeptide

SEQ ID NO: 2220 - protein, 120 aa, Artificial Sequence
  synthetic polypeptide
EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2221 - protein, 120 aa, Artificial Sequence
  synthetic polypeptide
EVQLLESGGGLVQPGGSLRLSCAASGFTFSSYGMNWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2222 - protein, 120 aa, Artificial Sequence
  synthetic polypeptide
EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARSANWHDTALDYWGQGTLVTVSS

SEQ ID NO: 2223 - protein, 120 aa, Artificial Sequence
  synthetic polypeptide
EVQLLESGGGLVQPGGSLRLSCAASGFTFSDYGMNWVRQAPGKGLEWVASINYNGGYTGYADSVKGRFTISRDNSKNTLYLQMNSLRAEDTAVYYCARSANWHDTALDYWGQGTLVTVSS

SEQ ID NO: 2224 - protein, 120 aa, Artificial Sequence
  synthetic polypeptide
EVQLLESGGGLVQPGGSLRLSCAASGFTFSDYSMNWVRQAPGKGLEWVSNINYNSGYTGYADSVKGRFTISRDNSKNTLYLQMNSLRAEDTAVYYCARSANWHDTALDYWGQGTLVTVSS

SEQ ID NO: 2225 - protein, 120 aa, Artificial Sequence
  synthetic polypeptide
EVQLLESGGGLVQPGGSLRLSCAASGFTFDSYGMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2226 - protein, 120 aa, Artificial Sequence
  synthetic polypeptide
EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSANWHDTALDYWGQGTLVTVSS

SEQ ID NO: 2227 - protein, 120 aa, Artificial Sequence; identical to SEQ ID NO: 2141
  synthetic polypeptide

SEQ ID NO: 2228 - protein, 120 aa, Artificial Sequence; identical to SEQ ID NO: 2195
  synthetic polypeptide

SEQ ID NO: 2229 - protein, 120 aa, Artificial Sequence; identical to SEQ ID NO: 2133
  synthetic polypeptide

SEQ ID NO: 2230 - protein, 120 aa, Artificial Sequence; identical to SEQ ID NO: 2204
  synthetic polypeptide

SEQ ID NO: 2231 - protein, 120 aa, Artificial Sequence
  synthetic polypeptide
EVQLLESGGGLVQPGGSLRLSCAASGFTFSSYGMNWVRQAPGKGLEWVASINYNSGYKSYADSVKGRFTISRDNSKNTLYLQMNSLRAEDTAVYYCARSANWHDTALDYWGQGTLVTVSS

SEQ ID NO: 2232 - protein, 120 aa, Artificial Sequence
  synthetic polypeptide
EVQLLESGGGLVQPGGSLRLSCAASGFTFSDYGMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2233 - protein, 120 aa, Artificial Sequence
  synthetic polypeptide
EVQLLESGGGLVQPGGSLRLSCAASGFTFDDYSMNWVRQAPGKGLEWVAGINYNGGYKGYADSVKGRFTISRDNSKNTLYLQMNSLRAEDTAVYYCARSANWHDTALDYWGQGTLVTVSS

SEQ ID NO: 2234 - protein, 120 aa, Artificial Sequence
  synthetic polypeptide
EVQLLESGGGLVQPGGSLRLSCAASGFTFDSYGMNWVRQAPGKGLEWVSNINYNSGYKSYADSVKGRFTISRDNSKNTLYLQMNSLRAEDTAVYYCARSANWHDTALDYWGQGTLVTVSS

SEQ ID NO: 2235 - protein, 120 aa, Artificial Sequence; identical to SEQ ID NO: 2234
  synthetic polypeptide

SEQ ID NO: 2236 - protein, 120 aa, Artificial Sequence; identical to SEQ ID NO: 2172
  synthetic polypeptide

SEQ ID NO: 2237 - protein, 120 aa, Artificial Sequence
  synthetic polypeptide
EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2238 - protein, 120 aa, Artificial Sequence
  synthetic polypeptide
EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2239 - protein, 120 aa, Artificial Sequence
  synthetic polypeptide
EVQLLESGGGLVQPGGSLRLSCAASGFTFSSYSMNWVRQAPGKGLEWVANINYNSGYKGYADSVKGRFTISRDNSKNTLYLQMNSLRAEDTAVYYCARSANWHDTALDYWGQGTLVTVSS

SEQ ID NO: 2240 - protein, 120 aa, Artificial Sequence
  synthetic polypeptide
EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2241 - protein, 120 aa, Artificial Sequence; identical to SEQ ID NO: 2150
  synthetic polypeptide

SEQ ID NO: 2242 - protein, 120 aa, Artificial Sequence
  synthetic polypeptide
EVQLLESGGGLVQPGGSLRLSCAASGFTFSSYGMNWVRQAPGKGLEWVANINYNGGYKSYADSVKGRFTISRDNSKNTLYLQMNSLRAEDTAVYYCARSANWHDTALDYWGQGTLVTVSS

SEQ ID NO: 2243 - protein, 120 aa, Artificial Sequence
  synthetic polypeptide
EVQLLESGGGLVQPGGSLRLSCAASGFTFDDYSMNWVRQAPGKGLEWVSGINYNGGYTSYADSVKGRFTISRDNSKNTLYLQMNSLRAEDTAVYYCARSANWHDTALDYWGQGTLVTVSS

SEQ ID NO: 2244 - protein, 120 aa, Artificial Sequence
  synthetic polypeptide
EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARSANWHDTALDYWGQGTLVTVSS

SEQ ID NO: 2245 - protein, 120 aa, Artificial Sequence
  synthetic polypeptide
EVQLLESGGGLVQPGGSLRLSCAASGFTFSSYSMNWVRQAPGKGLEWVSNINYNGGYTSYADSVKGRFTISRDNSKNTLYLQMNSLRAEDTAVYYCARSANWHDTALDYWGQGTLVTVSS

SEQ ID NO: 2246 - protein, 120 aa, Artificial Sequence; identical to SEQ ID NO: 2237
  synthetic polypeptide

SEQ ID NO: 2247 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2248 - protein, 120 aa, Artificial Sequence
  synthetic polypeptide
EVQLLESGGGLVQPGGSLRLSCAASGFTFDSYSMNWVRQAPGKGLEWVSGINYNSGYTGYADSVKGRFTISRDNSKNTLYLQMNSLRAEDTAVYYCARSANWHDTALDYWGQGTLVTVSS

SEQ ID NO: 2249 - protein, 120 aa, Artificial Sequence; identical to SEQ ID NO: 2194
  synthetic polypeptide

SEQ ID NO: 2250 - protein, 120 aa, Artificial Sequence; identical to SEQ ID NO: 2196
  synthetic polypeptide

SEQ ID NO: 2251 - protein, 120 aa, Artificial Sequence; identical to SEQ ID NO: 2194
  synthetic polypeptide

SEQ ID NO: 2252 - protein, 120 aa, Artificial Sequence; identical to SEQ ID NO: 2225
  synthetic polypeptide

SEQ ID NO: 2253 - protein, 120 aa, Artificial Sequence
  synthetic polypeptide
EVQLLESGGGLVQPGGSLRLSCAASGFTFDSYSMNWVRQAPGKGLEWVANINYNSGYKGYADSVKGRFTISRDNSKNTLYLQMNSLRAEDTAVYYCARSANWHDTALDYWGQGTLVTVSS

SEQ ID NO: 2254 - protein, 120 aa, Artificial Sequence
  synthetic polypeptide
EVQLLESGGGLVQPGGSLRLSCAASGFTFDSYSMNWVRQAPGKGLEWVSGINYNGGYTGYADSVKGRFTISRDNSKNTLYLQMNSLRAEDTAVYYCARSANWHDTALDYWGQGTLVTVSS

SEQ ID NO: 2255 - protein, 120 aa, Artificial Sequence
  synthetic polypeptide
EVQLLESGGGLVQPGGSLRLSCAASGFTFSSYGMNWVRQAPGKGLEWVSSINYNGGYKGYADSVKGRFTISRDNSKNTLYLQMNSLRAEDTAVYYCARSANWHDTALDYWGQGTLVTVSS

SEQ ID NO: 2256 - protein, 120 aa, Artificial Sequence; identical to SEQ ID NO: 2199
  synthetic polypeptide

SEQ ID NO: 2257 - protein, 120 aa, Artificial Sequence
  synthetic polypeptide
EVQLLESGGGLVQPGGSLRLSCAASGFTFDDSSMHWVRQAPGKGLEWVSNINYNGGYTGYADSVKGRFTISRDNSKNTLYLQMNSLRAEDTAVYYCAKSANWHDTALDYWGQGTLVTVSS

SEQ ID NO: 2258 - protein, 120 aa, Artificial Sequence; identical to SEQ ID NO: 2159
  synthetic polypeptide

SEQ ID NO: 2259 - protein, 120 aa, Artificial Sequence
  synthetic polypeptide
EVQLLESGGGLVQPGGSLRLSCAASGFTFDSYSMNWVRQAPGKGLEWVSNINYNGGYKGYADSVKGRFTISRDNSKNTLYLQMNSLRAEDTAVYYCARSANWHDTALDYWGQGTLVTVSS

SEQ ID NO: 2260 - protein, 120 aa, Artificial Sequence
  synthetic polypeptide
EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2261 - protein, 120 aa, Artificial Sequence
  synthetic polypeptide
EVQLLESGGGLVQPGGSLRLSCAASGFTFSDYSMNWVRQAPGKGLEWVANINYNGGYKGYADSVKGRFTISRDNSKNTLYLQMNSLRAEDTAVYYCARSANWHDTALDYWGQGTLVTVSS

SEQ ID NO: 2262 - protein, 120 aa, Artificial Sequence; identical to SEQ ID NO: 2240
  synthetic polypeptide

SEQ ID NO: 2263 - protein, 120 aa, Artificial Sequence
  synthetic polypeptide
EVQLLESGGGLVQPGGSLRLSCAASGFTFSDYGMHWVRQAPGKGLEWVSSINYNGGYTSYADSVKGRFTISRDNSKNTLYLQMNSLRAEDTAVYYCARSANWHDTALDYWGQGTLVTVSS

SEQ ID NO: 2264 - protein, 120 aa, Artificial Sequence; identical to SEQ ID NO: 2175
  synthetic polypeptide

SEQ ID NO: 2265 - protein, 120 aa, Artificial Sequence; identical to SEQ ID NO: 2232
  synthetic polypeptide

SEQ ID NO: 2266 - protein, 120 aa, Artificial Sequence
  synthetic polypeptide
EVQLLESGGGLVQPGGSLRLSCAASGFTFSSYSMNWVRQAPGKGLEWVASINYNSGYTSYADSVKGRFTISRDNSKNTLYLQMNSLRAEDTAVYYCARSANWHDTHLDYWGQGTLVTVSS

SEQ ID NO: 2267 - protein, 120 aa, Artificial Sequence
  synthetic polypeptide
EVQLLESGGGLVQPGGSLRLSCAASGFTFSSYSMNWVRQAPGKGLEWVSGINYNSGYKGYADSVKGRFTISRDNSKNTLYLQMNSLRAEDTAVYYCARSANWHDTALDYWGQGTLVTVSS

SEQ ID NO: 2268 - protein, 120 aa, Artificial Sequence
  synthetic polypeptide
EVQLLESGGGLVQPGGSLRLSCAASGFTFSSYGMNWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2269 - protein, 120 aa, Artificial Sequence
  synthetic polypeptide
EVQLLESGGGLVQPGGSLRLSCAASGFTFSDYGMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2270 - protein, 120 aa, Artificial Sequence; identical to SEQ ID NO: 2247
  synthetic polypeptide

SEQ ID NO: 2271 - protein, 120 aa, Artificial Sequence; identical to SEQ ID NO: 2201
  synthetic polypeptide

SEQ ID NO: 2272 - protein, 120 aa, Artificial Sequence
  synthetic polypeptide
EVQLLESGGGLVQPGGSLRLSCAASGFTFSSYGMHWVRQAPGKGLEWVSSINYNGGYTSYADSVKGRFTISRDNSKNTLYLQMNSLRAEDTAVYYCARSANWHDTALDYWGQGTLVTVSS

SEQ ID NO: 2273 - protein, 120 aa, Artificial Sequence; identical to SEQ ID NO: 2226
  synthetic polypeptide

SEQ ID NO: 2274 - protein, 120 aa, Artificial Sequence
  synthetic polypeptide
EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARSANWHDTALDYWGQGTLVTVSS

SEQ ID NO: 2275 - protein, 120 aa, Artificial Sequence
  synthetic polypeptide
EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2276 - protein, 120 aa, Artificial Sequence
  synthetic polypeptide
EVQLLESGGGLVQPGGSLRLSCAASGFTFSSYSMNWVRQAPGKGLEWVSNINYNGGYKGYADSVKGRFTISRDNSKNTLYLQMNSLRAEDTAVYYCARSANWHDTALDYWGQGTLVTVSS

SEQ ID NO: 2277 - protein, 120 aa, Artificial Sequence
  synthetic polypeptide
EVQLLESGGGLVQPGGSLRLSCAASGFTFDDYSMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2278 - protein, 120 aa, Artificial Sequence
  synthetic polypeptide
EVQLLESGGGLVQPGGSLRLSCAASGFTFSSYSMNWVRQAPGKGLEWVSNINYNSGYTGYADSVKGRFTISRDNSKNTLYLQMNSLRAEDTAVYYCARSANWHDTALDYWGQGTLVTVSS

SEQ ID NO: 2279 - protein, 120 aa, Artificial Sequence
  synthetic polypeptide
EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSANWHDTALDYWGQGTLVTVSS

SEQ ID NO: 2280 - protein, 120 aa, Artificial Sequence
  synthetic polypeptide
EVQLLESGGGLVQPGGSLRLSCAASGFTFDSYSMNWVRQAPGKGLEWVAGINYNSGYKGYADSVKGRFTISRDNSKNTLYLQMNSLRAEDTAVYYCARSANWHDTALDYWGQGTLVTVSS

SEQ ID NO: 2281 - protein, 120 aa, Artificial Sequence
  synthetic polypeptide
EVQLLESGGGLVQPGGSLRLSCAASGFTFDSYSMNWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2282 - protein, 120 aa, Artificial Sequence
  synthetic polypeptide
EVQLLESGGGLVQPGGSLRLSCAASGFTFDDYSMNWVRQAPGKGLEWVSGINYNGGYTGYADSVKGRFTISRDNSKNTLYLQMNSLRAEDTAVYYCARSANWHDTALDYWGQGTLVTVSS

SEQ ID NO: 2283 - protein, 120 aa, Artificial Sequence; identical to SEQ ID NO: 2248
  synthetic polypeptide

SEQ ID NO: 2284 - protein, 120 aa, Artificial Sequence
  synthetic polypeptide
EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARSANWHDTALDYWGQGTLVTVSS

SEQ ID NO: 2285 - protein, 120 aa, Artificial Sequence
  synthetic polypeptide
EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSANWHDTALDYWGQGTLVTVSS

SEQ ID NO: 2286 - protein, 120 aa, Artificial Sequence
  synthetic polypeptide
EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSANWHDTALDYWGQGTLVTVSS

SEQ ID NO: 2287 - protein, 120 aa, Artificial Sequence
  synthetic polypeptide
EVQLLESGGGLVQPGGSLRLSCAASGFTFDSYGMNWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2288 - protein, 120 aa, Artificial Sequence
  synthetic polypeptide
EVQLLESGGGLVQPGGSLRLSCAASGFTFSDYSMNWVRQAPGKGLEWVSNINYNSGYTSYADSVKGRFTISRDNSKNTLYLQMNSLRAEDTAVYYCARSANWHDTHLDYWGQGTLVTVSS

SEQ ID NO: 2289 - protein, 120 aa, Artificial Sequence
  synthetic polypeptide
EVQLLESGGGLVQPGGSLRLSCAASGFTFSSYGMHWVRQAPGKGLEWVAGINYNGGYTGYADSVKGRFTISRDNSKNTLYLQMNSLRAEDTAVYYCARSANWHDTALDYWGQGTLVTVSS

SEQ ID NO: 2290 - protein, 120 aa, Artificial Sequence; identical to SEQ ID NO: 2247
  synthetic polypeptide

SEQ ID NO: 2291 - protein, 120 aa, Artificial Sequence
  synthetic polypeptide
EVQLLESGGGLVQPGGSLRLSCAASGFTFSDYGMNWVRQAPGKGLEWVAGINYNGGYKSYADSVKGRFTISRDNSKNTLYLQMNSLRAEDTAVYYCARSANWHDTALDYWGQGTLVTVSS

SEQ ID NO: 2292 - protein, 120 aa, Artificial Sequence; identical to SEQ ID NO: 2224
  synthetic polypeptide

SEQ ID NO: 2293 - protein, 120 aa, Artificial Sequence; identical to SEQ ID NO: 2253
  synthetic polypeptide

SEQ ID NO: 2294 - protein, 120 aa, Artificial Sequence
  synthetic polypeptide
EVQLLESGGGLVQPGGSLRLSCAASGFTFDSYGMNWVRQAPGKGLEWVSGINYNGGYKGYADSVKGRFTISRDNSKNTLYLQMNSLRAEDTAVYYCARSANWHDTALDYWGQGTLVTVSS

SEQ ID NO: 2295 - protein, 120 aa, Artificial Sequence; identical to SEQ ID NO: 2141
  synthetic polypeptide

SEQ ID NO: 2296 - protein, 120 aa, Artificial Sequence; identical to SEQ ID NO: 2159
  synthetic polypeptide

SEQ ID NO: 2297 - protein, 120 aa, Artificial Sequence
  synthetic polypeptide
EVQLLESGGGLVQPGGSLRLSCAASGFTFSSYGMNWVRQAPGKGLEWVAGINYNSGYKGYADSVKGRFTISRDNSKNTLYLQMNSLRAEDTAVYYCARSANWHDTALDYWGQGTLVTVSS

SEQ ID NO: 2298 - protein, 120 aa, Artificial Sequence
  synthetic polypeptide
EVQLLESGGGLVQPGGSLRLSCAASGFTFSDYSMNWVRQAPGKGLEWVAGINYNGGYTGYADSVKGRFTISRDNSKNTLYLQMNSLRAEDTAVYYCARSANWHDTALDYWGQGTLVTVSS

SEQ ID NO: 2299 - protein, 120 aa, Artificial Sequence; identical to SEQ ID NO: 2167
  synthetic polypeptide

SEQ ID NO: 2300 - protein, 120 aa, Artificial Sequence
  synthetic polypeptide
EVQLLESGGGLVQPGGSLRLSCAASGFTFDSYGMNWVRQAPGKGLEWVSSINYNSGYTSYADSVKGRFTISRDNSKNTLYLQMNSLRAEDTAVYYCARSANWHDTALDYWGQGTLVTVSS

SEQ ID NO: 2301 - protein, 120 aa, Artificial Sequence
  synthetic polypeptide
EVQLLESGGGLVQPGGSLRLSCAASGFTFDDYSMNWVRQAPGKGLEWVSGINYNSGYKGYADSVKGRFTISRDNSKNTLYLQMNSLRAEDTAVYYCARSANWHDTALDYWGQGTLVTVSS

SEQ ID NO: 2302 - protein, 120 aa, Artificial Sequence; identical to SEQ ID NO: 2209
  synthetic polypeptide

SEQ ID NO: 2303 - protein, 120 aa, Artificial Sequence; identical to SEQ ID NO: 2279
  synthetic polypeptide

SEQ ID NO: 2304 - protein, 120 aa, Artificial Sequence
  synthetic polypeptide
EVQLLESGGGLVQPGGSLRLSCAASGFTFSSYSMNWVRQAPGKGLEWVANINYNGGYTSYADSVKGRFTISRDNSKNTLYLQMNSLRAEDTAVYYCARSANWHDTALDYWGQGTLVTVSS

SEQ ID NO: 2305 - protein, 120 aa, Artificial Sequence; identical to SEQ ID NO: 2155
  synthetic polypeptide

SEQ ID NO: 2306 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARSANWHDTHLDYWGQGTLVTVSS

SEQ ID NO: 2307 - protein, 120 aa, Artificial Sequence
  synthetic polypeptide
EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSANWHDTALDYWGQGTLVTVSS

SEQ ID NO: 2308 - protein, 120 aa, Artificial Sequence; identical to SEQ ID NO: 2267
  synthetic polypeptide

SEQ ID NO: 2309 - protein, 120 aa, Artificial Sequence; identical to SEQ ID NO: 2284
  synthetic polypeptide

SEQ ID NO: 2310 - protein, 120 aa, Artificial Sequence
  synthetic polypeptide
EVQLLESGGGLVQPGGSLRLSCAASGFTFDSYSMNWVRQAPGKGLEWVSNINYNSGYKGYADSVKGRFTISRDNSKNTLYLQMNSLRAEDTAVYYCARSANWHDTALDYWGQGTLVTVSS

SEQ ID NO: 2311 - protein, 120 aa, Artificial Sequence
  synthetic polypeptide
EVQLLESGGGLVQPGGSLRLSCAASGFTFSSYGMNWVRQAPGKGLEWVSGINYNGGYKGYADSVKGRFTISRDNSKNTLYLQMNSLRAEDTAVYYCARSANWHDTALDYWGQGTLVTVSS

SEQ ID NO: 2312 - protein, 120 aa, Artificial Sequence; identical to SEQ ID NO: 2167
  synthetic polypeptide

SEQ ID NO: 2313 - protein, 120 aa, Artificial Sequence; identical to SEQ ID NO: 2268
  synthetic polypeptide

SEQ ID NO: 2314 - protein, 120 aa, Artificial Sequence; identical to SEQ ID NO: 2240
  synthetic polypeptide

SEQ ID NO: 2315 - protein, 120 aa, Artificial Sequence
  synthetic polypeptide
EVQLLESGGGLVQPGGSLRLSCAASGFTFSDYGMNWVRQAPGKGLEWVSNINYNGGYKSYADSVKGRFTISRDNSKNTLYLQMNSLRAEDTAVYYCARSANWHDTALDYWGQGTLVTVSS

SEQ ID NO: 2316 - protein, 120 aa, Artificial Sequence; identical to SEQ ID NO: 2245
  synthetic polypeptide

SEQ ID NO: 2317 - protein, 120 aa, Artificial Sequence
  synthetic polypeptide
EVQLLESGGGLVQPGGSLRLSCAASGFTFDSYSMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2318 - protein, 120 aa, Artificial Sequence; identical to SEQ ID NO: 2261
  synthetic polypeptide

SEQ ID NO: 2319 - protein, 120 aa, Artificial Sequence; identical to SEQ ID NO: 2267
  synthetic polypeptide

SEQ ID NO: 2320 - protein, 120 aa, Artificial Sequence; identical to SEQ ID NO: 2278
  synthetic polypeptide

SEQ ID NO: 2321 - protein, 120 aa, Artificial Sequence
  synthetic polypeptide
EVQLLESGGGLVQPGGSLRLSCAASGFTFDSYSMNWVRQAPGKGLEWVAGINYNSGYKGYADSVKGRFTISRDNSKNTLYLQMNSLRAEDTAVYYCARSANWHDTHLDYWGQGTLVTVSS

SEQ ID NO: 2322 - protein, 120 aa, Artificial Sequence
  synthetic polypeptide
EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARSANWHDTHLDYWGQGTLVTVSS

SEQ ID NO: 2323 - protein, 120 aa, Artificial Sequence; identical to SEQ ID NO: 2286
  synthetic polypeptide

SEQ ID NO: 2324 - protein, 120 aa, Artificial Sequence
  synthetic polypeptide
EVQLLESGGGLVQPGGSLRLSCAASGFTFDDYSMNWVRQAPGKGLEWVSSINYNSGYKGYADSVKGRFTISRDNSKNTLYLQMNSLRAEDTAVYYCARSANWHDTALDYWGQGTLVTVSS

SEQ ID NO: 2325 - protein, 120 aa, Artificial Sequence; identical to SEQ ID NO: 2307
  synthetic polypeptide

SEQ ID NO: 2326 - protein, 120 aa, Artificial Sequence
  synthetic polypeptide
EVQLLESGGGLVQPGGSLRLSCAASGFTFDSYGMNWVRQAPGKGLEWVSGINYNSGYTGYADSVKGRFTISRDNSKNTLYLQMNSLRAEDTAVYYCARSANWHDTHLDYWGQGTLVTVSS

SEQ ID NO: 2327 - protein, 120 aa, Artificial Sequence; identical to SEQ ID NO: 2247
  synthetic polypeptide

SEQ ID NO: 2328 - protein, 120 aa, Artificial Sequence; identical to SEQ ID NO: 2161
  synthetic polypeptide

SEQ ID NO: 2329 - protein, 120 aa, Artificial Sequence; identical to SEQ ID NO: 2260
  synthetic polypeptide

SEQ ID NO: 2330 - protein, 120 aa, Artificial Sequence
  synthetic polypeptide
EVQLLESGGGLVQPGGSLRLSCAASGFTFSDYSMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2331 - protein, 120 aa, Artificial Sequence; identical to SEQ ID NO: 2175
  synthetic polypeptide

SEQ ID NO: 2332 - protein, 120 aa, Artificial Sequence; identical to SEQ ID NO: 2195
  synthetic polypeptide

SEQ ID NO: 2333 - protein, 120 aa, Artificial Sequence
  synthetic polypeptide
EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARSANWHDTALDYWGQGTLVTVSS

SEQ ID NO: 2334 - protein, 120 aa, Artificial Sequence
  synthetic polypeptide
EVQLLESGGGLVQPGGSLRLSCAASGFTFDSYSMNWVRQAPGKGLEWVANINYNSGYTSYADSVKGRFTISRDNSKNTLYLQMNSLRAEDTAVYYCARSANWHDTALDYWGQGTLVTVSS

SEQ ID NO: 2335 - protein, 120 aa, Artificial Sequence; identical to SEQ ID NO: 2199
  synthetic polypeptide

SEQ ID NO: 2336 - protein, 120 aa, Artificial Sequence; identical to SEQ ID NO: 2161
  synthetic polypeptide

SEQ ID NO: 2337 - protein, 120 aa, Artificial Sequence; identical to SEQ ID NO: 2333
  synthetic polypeptide

SEQ ID NO: 2338 - protein, 120 aa, Artificial Sequence; identical to SEQ ID NO: 2279
  synthetic polypeptide

SEQ ID NO: 2339 - protein, 120 aa, Artificial Sequence; identical to SEQ ID NO: 2136
  synthetic polypeptide

SEQ ID NO: 2340 - protein, 120 aa, Artificial Sequence; identical to SEQ ID NO: 2244
  synthetic polypeptide

SEQ ID NO: 2341 - protein, 120 aa, Artificial Sequence; identical to SEQ ID NO: 2199
  synthetic polypeptide

SEQ ID NO: 2342 - protein, 120 aa, Artificial Sequence; identical to SEQ ID NO: 2286
  synthetic polypeptide

SEQ ID NO: 2343 - protein, 120 aa, Artificial Sequence; identical to SEQ ID NO: 2218
  synthetic polypeptide

SEQ ID NO: 2344 - protein, 120 aa, Artificial Sequence
  synthetic polypeptide
EVQLLESGGGLVQPGGSLRLSCAASGFTFDSYGMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2345 - protein, 120 aa, Artificial Sequence
  synthetic polypeptide
EVQLLESGGGLVQPGGSLRLSCAASGFTFSSYSMNWVRQAPGKGLEWVANINYNSGYKSYADSVKGRFTISRDNSKNTLYLQMNSLRAEDTAVYYCARSANWHDTALDYWGQGTLVTVSS

SEQ ID NO: 2346 - protein, 120 aa, Artificial Sequence
  synthetic polypeptide
EVQLLESGGGLVQPGGSLRLSCAASGFTFSSYGMNWVRQAPGKGLEWVANINYNGGYKGYADSVKGRFTISRDNSKNTLYLQMNSLRAEDTAVYYCARSANWHDTALDYWGQGTLVTVSS

SEQ ID NO: 2347 - protein, 120 aa, Artificial Sequence
  synthetic polypeptide
EVQLLESGGGLVQPGGSLRLSCAASGFTFDDYGMHWVRQAPGKGLEWVASINYNSGYTSYADSVKGRFTISRDNSKNTLYLQMNSLRAEDTAVYYCARSANWHDTALDYWGQGTLVTVSS

SEQ ID NO: 2348 - protein, 120 aa, Artificial Sequence; identical to SEQ ID NO: 2257
  synthetic polypeptide

SEQ ID NO: 2349 - protein, 120 aa, Artificial Sequence; identical to SEQ ID NO: 2266
  synthetic polypeptide

SEQ ID NO: 2350 - protein, 120 aa, Artificial Sequence
  synthetic polypeptide
EVQLLESGGGLVQPGGSLRLSCAASGFTFSSYGMNWVRQAPGKGLEWVANINYNSGYTGYADSVKGRFTISRDNSKNTLYLQMNSLRAEDTAVYYCARSANWHDTALDYWGQGTLVTVSS

SEQ ID NO: 2351 - protein, 120 aa, Artificial Sequence
  synthetic polypeptide
EVQLLESGGGLVQPGGSLRLSCAASGFTFSDYGMNWVRQAPGKGLEWVSGINYNSGYKGYADSVKGRFTISRDNSKNTLYLQMNSLRAEDTAVYYCARSANWHDTALDYWGQGTLVTVSS

SEQ ID NO: 2352 - protein, 120 aa, Artificial Sequence; identical to SEQ ID NO: 2300
  synthetic polypeptide

SEQ ID NO: 2353 - protein, 120 aa, Artificial Sequence; identical to SEQ ID NO: 2244
  synthetic polypeptide

SEQ ID NO: 2354 - protein, 120 aa, Artificial Sequence
  synthetic polypeptide
EVQLLESGGGLVQPGGSLRLSCAASGFTFSDYSMNWVRQAPGKGLEWVAGINYNSGYKGYADSVKGRFTISRDNSKNTLYLQMNSLRAEDTAVYYCARSANWHDTALDYWGQGTLVTVSS

SEQ ID NO: 2355 - protein, 120 aa, Artificial Sequence; identical to SEQ ID NO: 2194
  synthetic polypeptide

SEQ ID NO: 2356 - protein, 120 aa, Artificial Sequence; identical to SEQ ID NO: 2285
  synthetic polypeptide

SEQ ID NO: 2357 - protein, 120 aa, Artificial Sequence
  synthetic polypeptide
EVQLLESGGGLVQPGGSLRLSCAASGFTFSDYGMNWVRQAPGKGLEWVSNINYNSGYKGYADSVKGRFTISRDNSKNTLYLQMNSLRAEDTAVYYCARSANWHDTALDYWGQGTLVTVSS

SEQ ID NO: 2358 - protein, 120 aa, Artificial Sequence; identical to SEQ ID NO: 2239
  synthetic polypeptide

SEQ ID NO: 2359 - protein, 120 aa, Artificial Sequence
  synthetic polypeptide
EVQLLESGGGLVQPGGSLRLSCAASGFTFDSYGMHWVRQAPGKGLEWVASINYNGGYTGYADSVKGRFTISRDNSKNTLYLQMNSLRAEDTAVYYCARSANWHDTALDYWGQGTLVTVSS

SEQ ID NO: 2360 - protein, 120 aa, Artificial Sequence; identical to SEQ ID NO: 2240
  synthetic polypeptide

SEQ ID NO: 2361 - protein, 120 aa, Artificial Sequence; identical to SEQ ID NO: 2253
  synthetic polypeptide

SEQ ID NO: 2362 - protein, 120 aa, Artificial Sequence; identical to SEQ ID NO: 2161
  synthetic polypeptide

SEQ ID NO: 2363 - protein, 120 aa, Artificial Sequence; identical to SEQ ID NO: 2275
  synthetic polypeptide

SEQ ID NO: 2364 - protein, 120 aa, Artificial Sequence; identical to SEQ ID NO: 2202
  synthetic polypeptide

SEQ ID NO: 2365 - protein, 120 aa, Artificial Sequence; identical to SEQ ID NO: 2279
  synthetic polypeptide

SEQ ID NO: 2366 - protein, 120 aa, Artificial Sequence; identical to SEQ ID NO: 2276
  synthetic polypeptide

SEQ ID NO: 2367 - protein, 120 aa, Artificial Sequence; identical to SEQ ID NO: 2150
  synthetic polypeptide

SEQ ID NO: 2368 - protein, 120 aa, Artificial Sequence; identical to SEQ ID NO: 2150
  synthetic polypeptide

SEQ ID NO: 2369 - protein, 120 aa, Artificial Sequence
  synthetic polypeptide
EVQLLESGGGLVQPGGSLRLSCAASGFTFSDYGMNWVRQAPGKGLEWVAGINYNGGYTSYADSVKGRFTISRDNSKNTLYLQMNSLRAEDTAVYYCARSANWHDTALDYWGQGTLVTVSS

SEQ ID NO: 2370 - protein, 120 aa, Artificial Sequence; identical to SEQ ID NO: 2344
  synthetic polypeptide

SEQ ID NO: 2371 - protein, 120 aa, Artificial Sequence
  synthetic polypeptide
EVQLLESGGGLVQPGGSLRLSCAASGFTFDSYSMNWVRQAPGKGLEWVSNINYNSGYTGYADSVKGRFTISRDNSKNTLYLQMNSLRAEDTAVYYCARSANWHDTALDYWGQGTLVTVSS

SEQ ID NO: 2372 - protein, 120 aa, Artificial Sequence; identical to SEQ ID NO: 2287
  synthetic polypeptide

SEQ ID NO: 2373 - protein, 120 aa, Artificial Sequence; identical to SEQ ID NO: 2307
  synthetic polypeptide

SEQ ID NO: 2374 - protein, 120 aa, Artificial Sequence
  synthetic polypeptide
EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARSANWHDTALDYWGQGTLVTVSS

SEQ ID NO: 2375 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARSANWHDTALDYWGQGTLVTVSS

SEQ ID NO: 2376 - protein, 107 aa, Artificial Sequence
  synthetic polypeptide
DIQMTQSPSSLSASVGDRVTITCRASQSILSYLNWYQQKPGKAPKLVIYAVTSRASGVPSRFSGSGSGTDFTLTISSLQPEDFATYYCQQSYDSPLTFGGGTKVEIK

SEQ ID NO: 2377 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYESPLTFGGGTKVEIK

SEQ ID NO: 2378 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSYENPLTFGGGTKVEIK

SEQ ID NO: 2379 - protein, 107 aa, Artificial Sequence
  synthetic polypeptide
DIQMTQSPSSLSASVGDRVTITCRASQSISSYVNWYQQKPGKAPKLVIYAATSRASGVPSRFSGSGSGTDFTLTISSLQPEDFATYYCQQSYESPLTFGGGTKVEIK

SEQ ID NO: 2380 - protein, 107 aa, Artificial Sequence
  synthetic polypeptide
DIQMTQSPSSLSASVGDRVTITCRASQSILTYVNWYQQKPGKAPKLLIYATTSLASGVPSRFSGSGSGTDFTLTISSLQPEDFATYYCQQSYDLPLTFGGGTKVEIK

SEQ ID NO: 2381 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYENPLTFGGGTKVEIK

SEQ ID NO: 2382 - protein, 107 aa, Artificial Sequence
  synthetic polypeptide
DIQMTQSPSSLSASVGDRVTITCRASQSIISYLNWYQQKPGKAPKLVIYATTSRHSGVPSRFSGSGSGTDFTLTISSLQPEDFATYYCQQSYDSPLTFGGGTKVEIK

SEQ ID NO: 2383 - protein, 107 aa, Artificial Sequence
  synthetic polypeptide
DIQMTQSPSSLSASVGDRVTITCRASQSIVSYLNWYQQKPGKAPKLVIYAVTSRASGVPSRFSGSGSGTDFTLTISSLQPEDFATYYCQQSYESPLTFGGGTKVEIK

SEQ ID NO: 2384 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYESPLTFGGGTKVEIK

SEQ ID NO: 2385 - protein, 107 aa, Artificial Sequence
  synthetic polypeptide
DIQMTQSPSSLSASVGDRVTITCRASQSIITYLNWYQQKPGKAPKLVIYAVTSRASGVPSRFSGSGSGTDFTLTISSLQPEDFATYYCQQSYSLPLTFGGGTKVEIK

SEQ ID NO: 2386 - protein, 107 aa, Artificial Sequence
  synthetic polypeptide
DIQMTQSPSSLSASVGDRVTITCRASQSIVSYVNWYQQKPGKAPKLVIYAVTSLASGVPSRFSGSGSGTDFTLTISSLQPEDFATYYCQQSYDTPLTFGGGTKVEIK

SEQ ID NO: 2387 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSDESPLTFGGGTKVEIK

SEQ ID NO: 2388 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYSSPLTFGGGTKVEIK

SEQ ID NO: 2389 - protein, 107 aa, Artificial Sequence; identical to SEQ ID NO: 1525
  synthetic polypeptide

SEQ ID NO: 2390 - protein, 107 aa, Artificial Sequence; identical to SEQ ID NO: 76
  synthetic polypeptide

SEQ ID NO: 2391 - protein, 107 aa, Artificial Sequence; identical to SEQ ID NO: 87
  synthetic polypeptide

SEQ ID NO: 2392 - protein, 107 aa, Artificial Sequence; identical to SEQ ID NO: 1209
  synthetic polypeptide

SEQ ID NO: 2393 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSDDSPLTFGGGTKVEIK

SEQ ID NO: 2394 - protein, 107 aa, Artificial Sequence
  synthetic polypeptide
DIQMTQSPSSLSASVGDRVTITCRASQSIVSYLNWYQQKPGKAPKLVIYAATSLASGVPSRFSGSGSGTDFTLTISSLQPEDFATYYCQQSYELPLTFGGGTKVEIK

SEQ ID NO: 2395 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSDNLPLTFGGGTKVEIK

SEQ ID NO: 2396 - protein, 107 aa, Artificial Sequence; identical to SEQ ID NO: 1314
  synthetic polypeptide

SEQ ID NO: 2397 - protein, 107 aa, Artificial Sequence
  synthetic polypeptide
DIQMTQSPSSLSASVGDRVTITCRASQSILTYVNWYQQKPGKAPKLLIYATTSRASGVPSRFSGSGSGTDFTLTISSLQPEDFATYYCQQSYDSPLTFGGGTKVEIK

SEQ ID NO: 2398 - protein, 107 aa, Artificial Sequence
  synthetic polypeptide
DIQMTQSPSSLSASVGDRVTITCRASQSIITYVNWYQQKPGKAPKLLIYAVTSRHSGVPSRFSGSGSGTDFTLTISSLQPEDFATYYCQQSYNSPLTFGGGTKVEIK

SEQ ID NO: 2399 - protein, 107 aa, Artificial Sequence; identical to SEQ ID NO: 2381
  synthetic polypeptide

SEQ ID NO: 2400 - protein, 107 aa, Artificial Sequence
  synthetic polypeptide
DIQMTQSPSSLSASVGDRVTITCRASQSILSYVNWYQQKPGKAPKLVIYAATSLHSGVPSRFSGSGSGTDFTLTISSLQPEDFATYYCQQSYNNPLTFGGGTKVEIK

SEQ ID NO: 2401 - protein, 107 aa, Artificial Sequence
  synthetic polypeptide
DIQMTQSPSSLSASVGDRVTITCRASQSISSYVNWYQQKPGKAPKLLIYAATSRASGVPSRFSGSGSGTDFTLTISSLQPEDFATYYCQQSYSTPLTFGGGTKVEIK

SEQ ID NO: 2402 - protein, 107 aa, Artificial Sequence
  synthetic polypeptide
DIQMTQSPSSLSASVGDRVTITCRASQSIVTYVNWYQQKPGKAPKLVIYAATSLASGVPSRFSGSGSGTDFTLTISSLQPEDFATYYCQQSYNTPLTFGGGTKVEIK

SEQ ID NO: 2403 - protein, 107 aa, Artificial Sequence; identical to SEQ ID NO: 1258
  synthetic polypeptide

SEQ ID NO: 2404 - protein, 107 aa, Artificial Sequence
  synthetic polypeptide
DIQMTQSPSSLSASVGDRVTITCRASQSIITYVNWYQQKPGKAPKLLIYAATSRASGVPSRFSGSGSGTDFTLTISSLQPEDFATYYCQQSYSTPLTFGGGTKVEIK

SEQ ID NO: 2405 - protein, 107 aa, Artificial Sequence
  synthetic polypeptide
DIQMTQSPSSLSASVGDRVTITCRASQSIVSYVNWYQQKPGKAPKLVIYAATSRHSGVPSRFSGSGSGTDFTLTISSLQPEDFATYYCQQSYESPLTFGGGTKVEIK

SEQ ID NO: 2406 - protein, 107 aa, Artificial Sequence; identical to SEQ ID NO: 1276
  synthetic polypeptide

SEQ ID NO: 2407 - protein, 107 aa, Artificial Sequence; identical to SEQ ID NO: 1501
  synthetic polypeptide

SEQ ID NO: 2408 - protein, 107 aa, Artificial Sequence; identical to SEQ ID NO: 584
  synthetic polypeptide

SEQ ID NO: 2409 - protein, 107 aa, Artificial Sequence
  synthetic polypeptide
DIQMTQSPSSLSASVGDRVTITCRASQSISSYVNWYQQKPGKAPKLLIYATTSRASGVPSRFSGSGSGTDFTLTISSLQPEDFATYYCQQSYETPLTFGGGTKVEIK

SEQ ID NO: 2410 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYSLPLTFGGGTKVEIK

SEQ ID NO: 2411 - protein, 107 aa, Artificial Sequence
  synthetic polypeptide
DIQMTQSPSSLSASVGDRVTITCRASQSILSYVNWYQQKPGKAPKLVIYATTSRHSGVPSRFSGSGSGTDFTLTISSLQPEDFATYYCQQSYESPLTFGGGTKVEIK

SEQ ID NO: 2412 - protein, 107 aa, Artificial Sequence; identical to SEQ ID NO: 561
  synthetic polypeptide

SEQ ID NO: 2413 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYETPLTFGGGTKVEIK

SEQ ID NO: 2414 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSDDTPLTFGGGTKVEIK

SEQ ID NO: 2415 - protein, 107 aa, Artificial Sequence
  synthetic polypeptide
DIQMTQSPSSLSASVGDRVTITCRASQSIISYVNWYQQKPGKAPKLVIYAATSRASGVPSRFSGSGSGTDFTLTISSLQPEDFATYYCQQSYENPLTFGGGTKVEIK

SEQ ID NO: 2416 - protein, 107 aa, Artificial Sequence
  synthetic polypeptide
DIQMTQSPSSLSASVGDRVTITCRASQSILSYLNWYQQKPGKAPKLLIYATTSRASGVPSRFSGSGSGTDFTLTISSLQPEDFATYYCQQSYDTPLTFGGGTKVEIK

SEQ ID NO: 2417 - protein, 107 aa, Artificial Sequence
  synthetic polypeptide
DIQMTQSPSSLSASVGDRVTITCRASQSIISYVNWYQQKPGKAPKLVIYAVTSRASGVPSRFSGSGSGTDFTLTISSLQPEDFATYYCQQSYENPLTFGGGTKVEIK

SEQ ID NO: 2418 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYNNPLTFGGGTKVEIK

SEQ ID NO: 2419 - protein, 107 aa, Artificial Sequence
  synthetic polypeptide
DIQMTQSPSSLSASVGDRVTITCRASQSIVSYVNWYQQKPGKAPKLVIYATTSRASGVPSRFSGSGSGTDFTLTISSLQPEDFATYYCQQSYSSPLTFGGGTKVEIK

SEQ ID NO: 2420 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSDDSPLTFGGGTKVEIK

SEQ ID NO: 2421 - protein, 107 aa, Artificial Sequence; identical to SEQ ID NO: 2376
  synthetic polypeptide

SEQ ID NO: 2422 - protein, 107 aa, Artificial Sequence; identical to SEQ ID NO: 1549
  synthetic polypeptide

SEQ ID NO: 2423 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYNLPLTFGGGTKVEIK

SEQ ID NO: 2424 - protein, 107 aa, Artificial Sequence
  synthetic polypeptide
DIQMTQSPSSLSASVGDRVTITCRASQSIISYVNWYQQKPGKAPKLLIYAATSLASGVPSRFSGSGSGTDFTLTISSLQPEDFATYYCQQSYNLPLTFGGGTKVEIK

SEQ ID NO: 2425 - protein, 107 aa, Artificial Sequence; identical to SEQ ID NO: 78
  synthetic polypeptide

SEQ ID NO: 2426 - protein, 107 aa, Artificial Sequence
  synthetic polypeptide
DIQMTQSPSSLSASVGDRVTITCRASQSILTYLNWYQQKPGKAPKLVIYATTSLHSGVPSRFSGSGSGTDFTLTISSLQPEDFATYYCQQSYDTPLTFGGGTKVEIK

SEQ ID NO: 2427 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYDLPLTFGGGTKVEIK

SEQ ID NO: 2428 - protein, 107 aa, Artificial Sequence
  synthetic polypeptide
DIQMTQSPSSLSASVGDRVTITCRASQSILSYLNWYQQKPGKAPKLVIYAATSRHSGVPSRFSGSGSGTDFTLTISSLQPEDFATYYCQQSYNTPLTFGGGTKVEIK

SEQ ID NO: 2429 - protein, 107 aa, Artificial Sequence
  synthetic polypeptide
DIQMTQSPSSLSASVGDRVTITCRASQSIISYLNWYQQKPGKAPKLVIYAATSRASGVPSRFSGSGSGTDFTLTISSLQPEDFATYYCQQSYDTPLTFGGGTKVEIK

SEQ ID NO: 2430 - protein, 107 aa, Artificial Sequence
  synthetic polypeptide
DIQMTQSPSSLSASVGDRVTITCRASQSILSYVNWYQQKPGKAPKLLIYATTSRASGVPSRFSGSGSGTDFTLTISSLQPEDFATYYCQQSYDLPLTFGGGTKVEIK

SEQ ID NO: 2431 - protein, 107 aa, Artificial Sequence; identical to SEQ ID NO: 582
  synthetic polypeptide

SEQ ID NO: 2432 - protein, 107 aa, Artificial Sequence [sequence omitted]

SEQ ID NO: 2433 - protein, 107 aa, Artificial Sequence
  synthetic polypeptide
DIQMTQSPSSLSASVGDRVTITCRASQSILSYLNWYQQKPGKAPKLVIYATTSRASGVPSRFSGSGSGTDFTLTISSLQPEDFATYYCQQSYETPLTFGGGTKVEIK

SEQ ID NO: 2434 - protein, 107 aa, Artificial Sequence
  synthetic polypeptide
DIQMTQSPSSLSASVGDRVTITCRASQSIVSYVNWYQQKPGKAPKLVIYAATSRHSGVPSRFSGSGSGTDFTLTISSLQPEDFATYYCQQSYDTPLTFGGGTKVEIK

SEQ ID NO: 2435 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSDDTPLTFGGGTKVEIK

SEQ ID NO: 2436 - protein, 107 aa, Artificial Sequence
  synthetic polypeptide
DIQMTQSPSSLSASVGDRVTITCRASQSIISYVNWYQQKPGKAPKLLIYAATSRASGVPSRFSGSGSGTDFTLTISSLQPEDFATYYCQQSYETPLTFGGGTKVEIK

SEQ ID NO: 2437 - protein, 107 aa, Artificial Sequence [sequence omitted]

SEQ ID NO: 2438 - protein, 107 aa, Artificial Sequence
  synthetic polypeptide
DIQMTQSPSSLSASVGDRVTITCRASQSIVSYLNWYQQKPGKAPKLVIYAATSLASGVPSRFSGSGSGTDFTLTISSLQPEDFATYYCQQSYDTPLTFGGGTKVEIK

SEQ ID NO: 2439 - protein, 107 aa, Artificial Sequence
  synthetic polypeptide
DIQMTQSPSSLSASVGDRVTITCRASQSILTYVNWYQQKPGKAPKLLIYATTSLHSGVPSRFSGSGSGTDFTLTISSLQPEDFATYYCQQSYDTPLTFGGGTKVEIK

SEQ ID NO: 2440 - protein, 107 aa, Artificial Sequence
  synthetic polypeptide
DIQMTQSPSSLSASVGDRVTITCRASQSIISYVNWYQQKPGKAPKLLIYAATSRASGVPSRFSGSGSGTDFTLTISSLQPEDFATYYCQQSYDSPLTFGGGTKVEIK

SEQ ID NO: 2441 - protein, 107 aa, Artificial Sequence; identical to SEQ ID NO: 1234
  synthetic polypeptide

SEQ ID NO: 2442 - protein, 107 aa, Artificial Sequence
  synthetic polypeptide
DIQMTQSPSSLSASVGDRVTITCRASQSIISYVNWYQQKPGKAPKLVIYAATSRASGVPSRFSGSGSGTDFTLTISSLQPEDFATYYCQQSYNSPLTFGGGTKVEIK

SEQ ID NO: 2443 - protein, 107 aa, Artificial Sequence
  synthetic polypeptide
DIQMTQSPSSLSASVGDRVTITCRASQSIISYLNWYQQKPGKAPKLLIYAATSRHSGVPSRFSGSGSGTDFTLTISSLQPEDFATYYCQQSYDNPLTFGGGTKVEIK

SEQ ID NO: 2444 - protein, 107 aa, Artificial Sequence; identical to SEQ ID NO: 105
  synthetic polypeptide

SEQ ID NO: 2445 - protein, 107 aa, Artificial Sequence
  synthetic polypeptide
DIQMTQSPSSLSASVGDRVTITCRASQSILTYLNWYQQKPGKAPKLVIYATTSRASGVPSRFSGSGSGTDFTLTISSLQPEDFATYYCQQSNELPLTFGGGTKVEIK

SEQ ID NO: 2446 - protein, 107 aa, Artificial Sequence
  synthetic polypeptide
DIQMTQSPSSLSASVGDRVTITCRASQSILSYVNWYQQKPGKAPKLLIYAVTSRASGVPSRFSGSGSGTDFTLTISSLQPEDFATYYCQQSYDSPLTFGGGTKVEIK

SEQ ID NO: 2447 - protein, 107 aa, Artificial Sequence
  synthetic polypeptide
DIQMTQSPSSLSASVGDRVTITCRASQSISSYLNWYQQKPGKAPKLLIYAATSRASGVPSRFSGSGSGTDFTLTISSLQPEDFATYYCQQSYETPLTFGGGTKVEIK

SEQ ID NO: 2448 - protein, 107 aa, Artificial Sequence; identical to SEQ ID NO: 1239
  synthetic polypeptide

SEQ ID NO: 2449 - protein, 107 aa, Artificial Sequence
  synthetic polypeptide
DIQMTQSPSSLSASVGDRVTITCRASQSIVSYLNWYQQKPGKAPKLLIYAATSLASGVPSRFSGSGSGTDFTLTISSLQPEDFATYYCQQSYSSPLTFGGGTKVEIK

SEQ ID NO: 2450 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSDSNPLTFGGGTKVEIK

SEQ ID NO: 2451 - protein, 107 aa, Artificial Sequence; identical to SEQ ID NO: 1289
  synthetic polypeptide

SEQ ID NO: 2452 - protein, 107 aa, Artificial Sequence
  synthetic polypeptide
DIQMTQSPSSLSASVGDRVTITCRASQSISTYVNWYQQKPGKAPKLVIYAVTSRHSGVPSRFSGSGSGTDFTLTISSLQPEDFATYYCQQSYDSPLTFGGGTKVEIK

SEQ ID NO: 2453 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSDDSPLTFGGGTKVEIK

SEQ ID NO: 2454 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYDLPLTFGGGTKVEIK

SEQ ID NO: 2455 - protein, 107 aa, Artificial Sequence
  synthetic polypeptide
DIQMTQSPSSLSASVGDRVTITCRASQSILSYLNWYQQKPGKAPKLLIYAVTSRHSGVPSRFSGSGSGTDFTLTISSLQPEDFATYYCQQSYSLPLTFGGGTKVEIK

SEQ ID NO: 2456 - protein, 107 aa, Artificial Sequence; identical to SEQ ID NO: 1219
  synthetic polypeptide

SEQ ID NO: 2457 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYDNPLTFGGGTKVEIK

SEQ ID NO: 2458 - protein, 107 aa, Artificial Sequence
  synthetic polypeptide
DIQMTQSPSSLSASVGDRVTITCRASQSILSYLNWYQQKPGKAPKLVIYGATSRASGVPSRFSGSGSGTDFTLTISSLQPEDFATYYCQQSYDSPLTFGGGTKVEIK

SEQ ID NO: 2459 - protein, 107 aa, Artificial Sequence
  synthetic polypeptide
DIQMTQSPSSLSASVGDRVTITCRASQSILSYLNWYQQKPGKAPKLLIYAVTSRASGVPSRFSGSGSGTDFTLTISSLQPEDFATYYCQQSYENPLTFGGGTKVEIK

SEQ ID NO: 2460 - protein, 107 aa, Artificial Sequence; identical to SEQ ID NO: 1259
  synthetic polypeptide

SEQ ID NO: 2461 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYNNPLTFGGGTKVEIK

SEQ ID NO: 2462 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYNLPLTFGGGTKVEIK

SEQ ID NO: 2463 - protein, 107 aa, Artificial Sequence
  synthetic polypeptide
DIQMTQSPSSLSASVGDRVTITCRASQSISSYVNWYQQKPGKAPKLVIYAVTSRASGVPSRFSGSGSGTDFTLTISSLQPEDFATYYCQQSYETPLTFGGGTKVEIK

SEQ ID NO: 2464 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYDSPLTFGGGTKVEIK

SEQ ID NO: 2465 - protein, 107 aa, Artificial Sequence; identical to SEQ ID NO: 70
  synthetic polypeptide

SEQ ID NO: 2466 - protein, 107 aa, Artificial Sequence
  synthetic polypeptide
DIQMTQSPSSLSASVGDRVTITCRASQSILTYLNWYQQKPGKAPKLLIYAVTSRHSGVPSRFSGSGSGTDFTLTISSLQPEDFATYYCQQGYDLPLTFGGGTKVEIK

SEQ ID NO: 2467 - protein, 107 aa, Artificial Sequence; identical to SEQ ID NO: 2459
  synthetic polypeptide

SEQ ID NO: 2468 - protein, 107 aa, Artificial Sequence; identical to SEQ ID NO: 99
  synthetic polypeptide

SEQ ID NO: 2469 - protein, 107 aa, Artificial Sequence; identical to SEQ ID NO: 81
  synthetic polypeptide

SEQ ID NO: 2470 - protein, 107 aa, Artificial Sequence
  synthetic polypeptide
DIQMTQSPSSLSASVGDRVTITCRASQSILTYVNWYQQKPGKAPKLLIYTTTSLHSGVPSRFSGSGSGTDFTLTISSLQPEDFATYYCQQSYNNPLTFGGGTKVEIK

SEQ ID NO: 2471 - protein, 107 aa, Artificial Sequence
  synthetic polypeptide
DIQMTQSPSSLSASVGDRVTITCRASQSILTYLNWYQQKPGKAPKLLIYAATSRASGVPSRFSGSGSGTDFTLTISSLQPEDFATYYCQQSYSNPLTFGGGTKVEIK

SEQ ID NO: 2472 - protein, 107 aa, Artificial Sequence
  synthetic polypeptide
DIQMTQSPSSLSASVGDRVTITCRASQSILSYLNWYQQKPGKAPKLVIYAVTSRASGVPSRFSGSGSGTDFTLTISSLQPEDFATYYCQQSYDTPLTFGGGTKVEIK

SEQ ID NO: 2473 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYNLPLTFGGGTKVEIK

SEQ ID NO: 2474 - protein, 107 aa, Artificial Sequence; identical to SEQ ID NO: 1536
  synthetic polypeptide

SEQ ID NO: 2475 - protein, 107 aa, Artificial Sequence
  synthetic polypeptide
DIQMTQSPSSLSASVGDRVTITCRASQSIVSYVNWYQQKPGKAPKLLIYATTSRHSGVPSRFSGSGSGTDFTLTISSLQPEDFATYYCQQSYDNPLTFGGGTKVEIK

SEQ ID NO: 2476 - protein, 107 aa, Artificial Sequence; identical to SEQ ID NO: 1254
  synthetic polypeptide

SEQ ID NO: 2477 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSYESPLTFGGGTKVEIK

SEQ ID NO: 2478 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYELPLTFGGGTKVEIK

SEQ ID NO: 2479 - protein, 107 aa, Artificial Sequence; identical to SEQ ID NO: 71
  synthetic polypeptide

SEQ ID NO: 2480 - protein, 107 aa, Artificial Sequence; identical to SEQ ID NO: 1364
  synthetic polypeptide

SEQ ID NO: 2481 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYDSPLTFGGGTKVEIK

SEQ ID NO: 2482 - protein, 107 aa, Artificial Sequence
  synthetic polypeptide
DIQMTQSPSSLSASVGDRVTITCRASQSIVTYLNWYQQKPGKAPKLLIYAVTSRASGVPSRFSGSGSGTDFTLTISSLQPEDFATYYCQQSYDLPLTFGGGTKVEIK

SEQ ID NO: 2483 - protein, 107 aa, Artificial Sequence; identical to SEQ ID NO: 1559
  synthetic polypeptide

SEQ ID NO: 2484 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYSSPLTFGGGTKVEIK

SEQ ID NO: 2485 - protein, 107 aa, Artificial Sequence
  synthetic polypeptide
DIQMTQSPSSLSASVGDRVTITCRASQSILTYVNWYQQKPGKAPKLLIYATTSRHSGVPSRFSGSGSGTDFTLTISSLQPEDFATYYCQQSYETPLTFGGGTKVEIK

SEQ ID NO: 2486 - protein, 107 aa, Artificial Sequence; identical to SEQ ID NO: 73
  synthetic polypeptide

SEQ ID NO: 2487 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYESPLTFGGGTKVEIK

SEQ ID NO: 2488 - protein, 107 aa, Artificial Sequence
  synthetic polypeptide
DIQMTQSPSSLSASVGDRVTITCRASQSILTYVNWYQQKPGKAPKLVIYAATSRHSGVPSRFSGSGSGTDFTLTISSLQPEDFATYYCQQSDNTPLTFGGGTKVEIK

SEQ ID NO: 2489 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYSNPLTFGGGTKVEIK

SEQ ID NO: 2490 - protein, 107 aa, Artificial Sequence; identical to SEQ ID NO: 89
  synthetic polypeptide

SEQ ID NO: 2491 - protein, 107 aa, Artificial Sequence
  synthetic polypeptide
DIQMTQSPSSLSASVGDRVTITCRASQSILSYVNWYQQKPGKAPKLLIYAVTSLASGVPSRFSGSGSGTDFTLTISSLQPEDFATYYCQQSYESPLTFGGGTKVEIK

SEQ ID NO: 2492 - protein, 107 aa, Artificial Sequence
  synthetic polypeptide
DIQMTQSPSSLSASVGDRVTITCRASQSISTYLNWYQQKPGKAPKLVIYAATSRASGVPSRFSGSGSGTDFTLTISSLQPEDFATYYCQQSYNLPLTFGGGTKVEIK

SEQ ID NO: 2493 - protein, 107 aa, Artificial Sequence; identical to SEQ ID NO: 1278
  synthetic polypeptide

SEQ ID NO: 2494 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYDNPLTFGGGTKVEIK

SEQ ID NO: 2495 - protein, 107 aa, Artificial Sequence; identical to SEQ ID NO: 1318
  synthetic polypeptide

SEQ ID NO: 2496 - protein, 107 aa, Artificial Sequence; identical to SEQ ID NO: 1480
  synthetic polypeptide

SEQ ID NO: 2497 - protein, 107 aa, Artificial Sequence
  synthetic polypeptide
DIQMTQSPSSLSASVGDRVTITCRASQSILTYLNWYQQKPGKAPKLLIYYVTNRQSGVPSRFSGSGSGTDFTLTISSLQPEDFATYYCQQSYSSPLTFGGGTKVEIK

SEQ ID NO: 2498 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYNSPLTFGGGTKVEIK

SEQ ID NO: 2499 - protein, 107 aa, Artificial Sequence
  synthetic polypeptide
DIQMTQSPSSLSASVGDRVTITCRASQSISNYLNWYQQKPGKAPKLLIYAVTSRASGVPSRFSGSGSGTDFTLTISSLQPEDFATYYCQQSYDSPLTFGGGTKVEIK

SEQ ID NO: 2500 - protein, 107 aa, Artificial Sequence
  synthetic polypeptide
DIQMTQSPSSLSASVGDRVTITCRASQSIISYLNWYQQKPGKAPKLVIYAATSLASGVPSRFSGSGSGTDFTLTISSLQPEDFATYYCQQSYSTPLTFGGGTKVEIK

SEQ ID NO: 2501 - protein, 107 aa, Artificial Sequence; identical to SEQ ID NO: 78
  synthetic polypeptide

SEQ ID NO: 2502 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYDTPLTFGGGTKVEIK

SEQ ID NO: 2503 - protein, 107 aa, Artificial Sequence
  synthetic polypeptide
DIQMTQSPSSLSASVGDRVTITCRASQSILTYLNWYQQKPGKAPKLVIYYASNRASGVPSRFSGSGSGTDFTLTISSLQPEDFATYYCQQSYDSPLTFGGGTKVEIK

SEQ ID NO: 2504 - protein, 107 aa, Artificial Sequence
  synthetic polypeptide
DIQMTQSPSSLSASVGDRVTITCRASQSILSYLNWYQQKPGKAPKLVIYATTSLASGVPSRFSGSGSGTDFTLTISSLQPEDFATYYCQQSYDTPLTFGGGTKVEIK

SEQ ID NO: 2505 - protein, 107 aa, Artificial Sequence; identical to SEQ ID NO: 1499
  synthetic polypeptide

SEQ ID NO: 2506 - protein, 107 aa, Artificial Sequence; identical to SEQ ID NO: 571
  synthetic polypeptide

SEQ ID NO: 2507 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYNLPLTFGGGTKVEIK

SEQ ID NO: 2508 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYNSPLTFGGGTKVEIK

SEQ ID NO: 2509 - protein, 107 aa, Artificial Sequence; identical to SEQ ID NO: 1516
  synthetic polypeptide

SEQ ID NO: 2510 - protein, 107 aa, Artificial Sequence
  synthetic polypeptide
DIQMTQSPSSLSASVGDRVTITCRASQSILTYVNWYQQKPGKAPKLVIYATTSRASGVPSRFSGSGSGTDFTLTISSLQPEDFATYYCQQSYNNPLTFGGGTKVEIK

SEQ ID NO: 2511 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSDNTPLTFGGGTKVEIK

SEQ ID NO: 2512 - protein, 107 aa, Artificial Sequence; identical to SEQ ID NO: 591
  synthetic polypeptide

SEQ ID NO: 2513 - protein, 107 aa, Artificial Sequence
  synthetic polypeptide
DIQMTQSPSSLSASVGDRVTITCRASQSISSYLNWYQQKPGKAPKLLIYVVNNRASGVPSRFSGSGSGTDFTLTISSLQPEDFATYYCQQSYENPLTFGGGTKVEIK

SEQ ID NO: 2514 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYSLPLTFGGGTKVEIK

SEQ ID NO: 2515 - protein, 107 aa, Artificial Sequence; identical to SEQ ID NO: 1490
  synthetic polypeptide

SEQ ID NO: 2516 - protein, 107 aa, Artificial Sequence
  synthetic polypeptide
DIQMTQSPSSLSASVGDRVTITCRASQSIVSYVNWYQQKPGKAPKLLIYAATSRASGVPSRFSGSGSGTDFTLTISSLQPEDFATYYCQQSYDNPLTFGGGTKVEIK

SEQ ID NO: 2517 - protein, 107 aa, Artificial Sequence
  synthetic polypeptide
DIQMTQSPSSLSASVGDRVTITCRASQSILSYLNWYQQKPGKAPKLVIYATTSRASGVPSRFSGSGSGTDFTLTISSLQPEDFATYYCQQSYESPLTFGGGTKVEIK

SEQ ID NO: 2518 - protein, 107 aa, Artificial Sequence; identical to SEQ ID NO: 537
  synthetic polypeptide

SEQ ID NO: 2519 - protein, 107 aa, Artificial Sequence
  synthetic polypeptide
DIQMTQSPSSLSASVGDRVTITCRASQSILSYLNWYQQKPGKAPKLVIYATTSRASGVPSRFSGSGSGTDFTLTISSLQPEDFATYYCQQSYDLPLTFGGGTKVEIK

SEQ ID NO: 2520 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYELPLTFGGGTKVEIK

SEQ ID NO: 2521 - protein, 107 aa, Artificial Sequence; identical to SEQ ID NO: 1231
  synthetic polypeptide

SEQ ID NO: 2522 - protein, 107 aa, Artificial Sequence
  synthetic polypeptide
DIQMTQSPSSLSASVGDRVTITCRASQSILTYVNWYQQKPGKAPKLVIYAATSRHSGVPSRFSGSGSGTDFTLTISSLQPEDFATYYCQQSYNLPLTFGGGTKVEIK

SEQ ID NO: 2523 - protein, 107 aa, Artificial Sequence; identical to SEQ ID NO: 2478
  synthetic polypeptide

SEQ ID NO: 2524 - protein, 107 aa, Artificial Sequence
  synthetic polypeptide
DIQMTQSPSSLSASVGDRVTITCRASQSILSYLNWYQQKPGKAPKLVIYATTSRASGVPSRFSGSGSGTDFTLTISSLQPEDFATYYCQQSYSTPLTFGGGTKVEIK

SEQ ID NO: 2525 - protein, 107 aa, Artificial Sequence
  synthetic polypeptide
DIQMTQSPSSLSASVGDRVTITCRASQSIISYVNWYQQKPGKAPKLLIYAATSRASGVPSRFSGSGSGTDFTLTISSLQPEDFATYYCQQSYSTPLTFGGGTKVEIK

SEQ ID NO: 2526 - protein, 107 aa, Artificial Sequence
  synthetic polypeptide
DIQMTQSPSSLSASVGDRVTITCRASQSILTYLNWYQQKPGKAPKLVIYAATSRASGVPSRFSGSGSGTDFTLTISSLQPEDFATYYCQQSYNNPLTFGGGTKVEIK

SEQ ID NO: 2527 - protein, 107 aa, Artificial Sequence; identical to SEQ ID NO: 576
  synthetic polypeptide

SEQ ID NO: 2528 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYNNPLTFGGGTKVEIK

SEQ ID NO: 2529 - protein, 107 aa, Artificial Sequence
  synthetic polypeptide
DIQMTQSPSSLSASVGDRVTITCRASQSIVSYLNWYQQKPGKAPKLVIYAATSRHSGVPSRFSGSGSGTDFTLTISSLQPEDFATYYCQQSYNSPLTFGGGTKVEIK

SEQ ID NO: 2530 - protein, 107 aa, Artificial Sequence; identical to SEQ ID NO: 2405
  synthetic polypeptide

SEQ ID NO: 2531 - protein, 107 aa, Artificial Sequence
  synthetic polypeptide
DIQMTQSPSSLSASVGDRVTITCRASQSISSYLNWYQQKPGKAPKLLIYAVTSRASGVPSRFSGSGSGTDFTLTISSLQPEDFATYYCQQSYSSPLTFGGGTKVEIK

SEQ ID NO: 2532 - protein, 107 aa, Artificial Sequence
  synthetic polypeptide
DIQMTQSPSSLSASVGDRVTITCRASQSISSYVNWYQQKPGKAPKLLIYAATSRHSGVPSRFSGSGSGTDFTLTISSLQPEDFATYYCQQSDDSPLTFGGGTKVEIK

SEQ ID NO: 2533 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYDSPLTFGGGTKVEIK

SEQ ID NO: 2534 - protein, 107 aa, Artificial Sequence; identical to SEQ ID NO: 1310
  synthetic polypeptide

SEQ ID NO: 2535 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSYDSPLTFGGGTKVEIK

SEQ ID NO: 2536 - protein, 107 aa, Artificial Sequence
  synthetic polypeptide
DIQMTQSPSSLSASVGDRVTITCRASQSILSYLNWYQQKPGKAPKLVIYAATSRHSGVPSRFSGSGSGTDFTLTISSLQPEDFATYYCQQSDNTPLTFGGGTKVEIK

SEQ ID NO: 2537 - protein, 107 aa, Artificial Sequence; identical to SEQ ID NO: 78
  synthetic polypeptide

SEQ ID NO: 2538 - protein, 107 aa, Artificial Sequence; identical to SEQ ID NO: 569
  synthetic polypeptide

SEQ ID NO: 2539 - protein, 107 aa, Artificial Sequence
  synthetic polypeptide
DIQMTQSPSSLSASVGDRVTITCRASQSILSYVNWYQQKPGKAPKLLIYAATSLASGVPSRFSGSGSGTDFTLTISSLQPEDFATYYCQQSYETPLTFGGGTKVEIK

SEQ ID NO: 2540 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYDTPLTFGGGTKVEIK

SEQ ID NO: 2541 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSYSSPLTFGGGTKVEIK

SEQ ID NO: 2542 - protein, 107 aa, Artificial Sequence
  synthetic polypeptide
DIQMTQSPSSLSASVGDRVTITCRASQSILSYVNWYQQKPGKAPKLVIYATTSLASGVPSRFSGSGSGTDFTLTISSLQPEDFATYYCQQSYNTPLTFGGGTKVEIK

SEQ ID NO: 2543 - protein, 107 aa, Artificial Sequence
  synthetic polypeptide
DIQMTQSPSSLSASVGDRVTITCRASQSIVSYVNWYQQKPGKAPKLLIYAATSLASGVPSRFSGSGSGTDFTLTISSLQPEDFATYYCQQSYSLPLTFGGGTKVEIK

SEQ ID NO: 2544 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYDLPLTFGGGTKVEIK

SEQ ID NO: 2545 - protein, 107 aa, Artificial Sequence; identical to SEQ ID NO: 1207
  synthetic polypeptide

SEQ ID NO: 2546 - protein, 107 aa, Artificial Sequence
  synthetic polypeptide
DIQMTQSPSSLSASVGDRVTITCRASQSILTYVNWYQQKPGKAPKLVIYAATSRHSGVPSRFSGSGSGTDFTLTISSLQPEDFATYYCQQSYESPLTFGGGTKVEIK

SEQ ID NO: 2547 - protein, 107 aa, Artificial Sequence; identical to SEQ ID NO: 1287
  synthetic polypeptide

SEQ ID NO: 2548 - protein, 107 aa, Artificial Sequence; identical to SEQ ID NO: 2464
  synthetic polypeptide

SEQ ID NO: 2549 - protein, 107 aa, Artificial Sequence
  synthetic polypeptide
DIQMTQSPSSLSASVGDRVTITCRASQSILSYVNWYQQKPGKAPKLLIYAATSRASGVPSRFSGSGSGTDFTLTISSLQPEDFATYYCQQSYNTPLTFGGGTKVEIK

SEQ ID NO: 2550 - protein, 107 aa, Artificial Sequence
  synthetic polypeptide
DIQMTQSPSSLSASVGDRVTITCRASQSIISYVNWYQQKPGKAPKLVIYAVTSRASGVPSRFSGSGSGTDFTLTISSLQPEDFATYYCQQSYNSPLTFGGGTKVEIK

SEQ ID NO: 2551 - protein, 107 aa, Artificial Sequence; identical to SEQ ID NO: 1506
  synthetic polypeptide

SEQ ID NO: 2552 - protein, 107 aa, Artificial Sequence
  synthetic polypeptide
DIQMTQSPSSLSASVGDRVTITCRASQSIISYLNWYQQKPGKAPKLLIYAASSLQSGVPSRFSGSGSGTDFTLTISSLQPEDFATYYCQQSYNNPLTFGGGTKVEIK

SEQ ID NO: 2553 - protein, 107 aa, Artificial Sequence
  synthetic polypeptide
DIQMTQSPSSLSASVGDRVTITCRASQSILTYVNWYQQKPGKAPKLVIYAVTSRASGVPSRFSGSGSGTDFTLTISSLQPEDFATYYCQQSYETPLTFGGGTKVEIK

SEQ ID NO: 2554 - protein, 107 aa, Artificial Sequence; identical to SEQ ID NO: 1333
  synthetic polypeptide

SEQ ID NO: 2555 - protein, 107 aa, Artificial Sequence; identical to SEQ ID NO: 1238
  synthetic polypeptide

SEQ ID NO: 2556 - protein, 107 aa, Artificial Sequence; identical to SEQ ID NO: 91
  synthetic polypeptide

SEQ ID NO: 2557 - protein, 107 aa, Artificial Sequence; identical to SEQ ID NO: 567
  synthetic polypeptide

SEQ ID NO: 2558 - protein, 107 aa, Artificial Sequence; identical to SEQ ID NO: 70
  synthetic polypeptide

SEQ ID NO: 2559 - protein, 107 aa, Artificial Sequence
  synthetic polypeptide
DIQMTQSPSSLSASVGDRVTITCRASQSIVSYVNWYQQKPGKAPKLLIYAATSRHSGVPSRFSGSGSGTDFTLTISSLQPEDFATYYCQQSYNNPLTFGGGTKVEIK

SEQ ID NO: 2560 - protein, 107 aa, Artificial Sequence
  synthetic polypeptide
DIQMTQSPSSLSASVGDRVTITCRASQSILSYVNWYQQKPGKAPKLLIYAVTSRASGVPSRFSGSGSGTDFTLTISSLQPEDFATYYCQQSYDLPLTFGGGTKVEIK

SEQ ID NO: 2561 - protein, 107 aa, Artificial Sequence
  synthetic polypeptide
DIQMTQSPSSLSASVGDRVTITCRASQSILTYVNWYQQKPGKAPKLLIYAATSLASGVPSRFSGSGSGTDFTLTISSLQPEDFATYYCQQSYETPLTFGGGTKVEIK

SEQ ID NO: 2562 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYDTPLTFGGGTKVEIK

SEQ ID NO: 2563 - protein, 107 aa, Artificial Sequence; identical to SEQ ID NO: 67
  synthetic polypeptide

SEQ ID NO: 2564 - protein, 107 aa, Artificial Sequence
  synthetic polypeptide
DIQMTQSPSSLSASVGDRVTITCRASQSILSYLNWYQQKPGKAPKLLIYATTSLASGVPSRFSGSGSGTDFTLTISSLQPEDFATYYCQQSYNSPLTFGGGTKVEIK

SEQ ID NO: 2565 - protein, 107 aa, Artificial Sequence; identical to SEQ ID NO: 1302
  synthetic polypeptide

SEQ ID NO: 2566 - protein, 107 aa, Artificial Sequence; identical to SEQ ID NO: 1377
  synthetic polypeptide

SEQ ID NO: 2567 - protein, 107 aa, Artificial Sequence; identical to SEQ ID NO: 2560
  synthetic polypeptide

SEQ ID NO: 2568 - protein, 107 aa, Artificial Sequence
  synthetic polypeptide
DIQMTQSPSSLSASVGDRVTITCRASQSIVSYLNWYQQKPGKAPKLLIYAVTSRASGVPSRFSGSGSGTDFTLTISSLQPEDFATYYCQQSYESPLTFGGGTKVEIK

SEQ ID NO: 2569 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYDTPLTFGGGTKVEIK

SEQ ID NO: 2570 - protein, 107 aa, Artificial Sequence
  synthetic polypeptide
DIQMTQSPSSLSASVGDRVTITCRASQSISSYLNWYQQKPGKAPKLVIYAATSRASGVPSRFSGSGSGTDFTLTISSLQPEDFATYYCQQSYDNPLTFGGGTKVEIK

SEQ ID NO: 2571 - protein, 107 aa, Artificial Sequence; identical to SEQ ID NO: 1258
  synthetic polypeptide

SEQ ID NO: 2572 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYNSPLTFGGGTKVEIK

SEQ ID NO: 2573 - protein, 107 aa, Artificial Sequence
  synthetic polypeptide
DIQMTQSPSSLSASVGDRVTITCRASQSIITYVNWYQQKPGKAPKLLIYAATSLASGVPSRFSGSGSGTDFTLTISSLQPEDFATYYCQQSYSSPLTFGGGTKVEIK

SEQ ID NO: 2574 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYESPLTFGGGTKVEIK

SEQ ID NO: 2575 - protein, 107 aa, Artificial Sequence; identical to SEQ ID NO: 2401
  synthetic polypeptide

SEQ ID NO: 2576 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSYDLPLTFGGGTKVEIK

SEQ ID NO: 2577 - protein, 107 aa, Artificial Sequence
  synthetic polypeptide
DIQMTQSPSSLSASVGDRVTITCRASQSILSFVNWYQQKPGKAPKLVIYAATSRASGVPSRFSGSGSGTDFTLTISSLQPEDFATYYCQQSYNLPLTFGGGTKVEIK

SEQ ID NO: 2578 - protein, 107 aa, Artificial Sequence
  synthetic polypeptide
DIQMTQSPSSLSASVGDRVTITCRASQSIITYVNWYQQKPGKAPKLVIYAATSRASGVPSRFSGSGSGTDFTLTISSLQPEDFATYYCQQSYNTPLTFGGGTKVEIK

SEQ ID NO: 2579 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYDLPLTFGGGTKVEIK

SEQ ID NO: 2580 - protein, 107 aa, Artificial Sequence; identical to SEQ ID NO: 1262
  synthetic polypeptide

SEQ ID NO: 2581 - protein, 107 aa, Artificial Sequence; identical to SEQ ID NO: 557
  synthetic polypeptide

SEQ ID NO: 2582 - protein, 107 aa, Artificial Sequence
  synthetic polypeptide
DIQMTQSPSSLSASVGDRVTITCRASQSIVSYLNWYQQKPGKAPKLLIYAASSLQSGVPSRFSGSGSGTDFTLTISSLQPEDFATYYCQQSYELPLTFGGGTKVEIK

SEQ ID NO: 2583 - protein, 107 aa, Artificial Sequence; identical to SEQ ID NO: 2572
  synthetic polypeptide

SEQ ID NO: 2584 - protein, 107 aa, Artificial Sequence; identical to SEQ ID NO: 1302
  synthetic polypeptide

SEQ ID NO: 2585 - protein, 107 aa, Artificial Sequence
  synthetic polypeptide
DIQMTQSPSSLSASVGDRVTITCRASQSILSYLNWYQQKPGKAPKLLIYAVTSLASGVPSRFSGSGSGTDFTLTISSLQPEDFATYYCQQSYESPLTFGGGTKVEIK

SEQ ID NO: 2586 - protein, 107 aa, Artificial Sequence; identical to SEQ ID NO: 1357
  synthetic polypeptide

SEQ ID NO: 2587 - protein, 107 aa, Artificial Sequence
  synthetic polypeptide
DIQMTQSPSSLSASVGDRVTITCRASQSILSYLNWYQQKPGKAPKLLIYAVTSRASGVPSRFSGSGSGTDFTLTISSLQPEDFATYYCQQSYDLPLTFGGGTKVEIK

SEQ ID NO: 2588 - protein, 107 aa, Artificial Sequence; identical to SEQ ID NO: 76
  synthetic polypeptide

SEQ ID NO: 2589 - protein, 107 aa, Artificial Sequence; identical to SEQ ID NO: 1333
  synthetic polypeptide

SEQ ID NO: 2590 - protein, 107 aa, Artificial Sequence; identical to SEQ ID NO: 1542
  synthetic polypeptide

SEQ ID NO: 2591 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYNLPLTFGGGTKVEIK

SEQ ID NO: 2592 - protein, 107 aa, Artificial Sequence; identical to SEQ ID NO: 1207
  synthetic polypeptide

SEQ ID NO: 2593 - protein, 107 aa, Artificial Sequence
  synthetic polypeptide
DIQMTQSPSSLSASVGDRVTITCRASQSILSYLNWYQQKPGKAPKLVIYAVTSLASGVPSRFSGSGSGTDFTLTISSLQPEDFATYYCQQSYDLPLTFGGGTKVEIK

SEQ ID NO: 2594 - protein, 107 aa, Artificial Sequence; identical to SEQ ID NO: 1287
  synthetic polypeptide

SEQ ID NO: 2595 - protein, 107 aa, Artificial Sequence
  synthetic polypeptide
DIQMTQSPSSLSASVGDRVTITCRASQSILTYVNWYQQKPGKAPKLVIYATTSRASGVPSRFSGSGSGTDFTLTISSLQPEDFATYYCQQSYDSPLTFGGGTKVEIK

SEQ ID NO: 2596 - protein, 107 aa, Artificial Sequence; identical to SEQ ID NO: 1499
  synthetic polypeptide

SEQ ID NO: 2597 - protein, 107 aa, Artificial Sequence
  synthetic polypeptide
DIQMTQSPSSLSASVGDRVTITCRASQSIVSYLNWYQQKPGKAPKLLIYAATSLHSGVPSRFSGSGSGTDFTLTISSLQPEDFATYYCQQSYDTPLTFGGGTKVEIK

SEQ ID NO: 2598 - protein, 107 aa, Artificial Sequence; identical to SEQ ID NO: 1234
  synthetic polypeptide

SEQ ID NO: 2599 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYSTPLTFGGGTKVEIK

SEQ ID NO: 2600 - protein, 107 aa, Artificial Sequence; identical to SEQ ID NO: 1377
  synthetic polypeptide

SEQ ID NO: 2601 - protein, 107 aa, Artificial Sequence; identical to SEQ ID NO: 2453
  synthetic polypeptide

SEQ ID NO: 2602 - protein, 107 aa, Artificial Sequence
  synthetic polypeptide
DIQMTQSPSSLSASVGDRVTITCRASQSIVTYLNWYQQKPGKAPKLLIYVVTNRESGVPSRFSGSGSGTDFTLTISSLQPEDFATYYCQQSYETPLTFGGGTKVEIK

SEQ ID NO: 2603 - protein, 107 aa, Artificial Sequence
  synthetic polypeptide
DIQMTQSPSSLSASVGDRVTITCRASQSILTYLNWYQQKPGKAPKLLIYYVTNRQSGVPSRFSGSGSGTDFTLTISSLQPEDFATYYCQQSYSIPLTFGGGTKVEIK

SEQ ID NO: 2604 - protein, 107 aa, Artificial Sequence; identical to SEQ ID NO: 1262
  synthetic polypeptide

SEQ ID NO: 2605 - protein, 107 aa, Artificial Sequence; identical to SEQ ID NO: 582
  synthetic polypeptide

SEQ ID NO: 2606 - protein, 107 aa, Artificial Sequence; identical to SEQ ID NO: 2562
  synthetic polypeptide

SEQ ID NO: 2607 - protein, 107 aa, Artificial Sequence; identical to SEQ ID NO: 1506
  synthetic polypeptide

SEQ ID NO: 2608 - protein, 107 aa, Artificial Sequence
  synthetic polypeptide
DIQMTQSPSSLSASVGDRVTITCRASQSIISYVNWYQQKPGKAPKLLIYAATSRASGVPSRFSGSGSGTDFTLTISSLQPEDFATYYCQQSYELPLTFGGGTKVEIK

SEQ ID NO: 2609 - protein, 107 aa, Artificial Sequence; identical to SEQ ID NO: 1382
  synthetic polypeptide

SEQ ID NO: 2610 - protein, 107 aa, Artificial Sequence; identical to SEQ ID NO: 583
  synthetic polypeptide

SEQ ID NO: 2611 - protein, 107 aa, Artificial Sequence; identical to SEQ ID NO: 1494
  synthetic polypeptide

SEQ ID NO: 2612 - protein, 107 aa, Artificial Sequence; identical to SEQ ID NO: 1344
  synthetic polypeptide

SEQ ID NO: 2613 - protein, 107 aa, Artificial Sequence; identical to SEQ ID NO: 1513
  synthetic polypeptide

SEQ ID NO: 2614 - protein, 107 aa, Artificial Sequence
  synthetic polypeptide
DIQMTQSPSSLSASVGDRVTITCRASQSIVSYVNWYQQKPGKAPKLLIYAATSLASGVPSRFSGSGSGTDFTLTISSLQPEDFATYYCQQSYDTPLTFGGGTKVEIK

SEQ ID NO: 2615 - protein, 107 aa, Artificial Sequence; identical to SEQ ID NO: 1263
  synthetic polypeptide

SEQ ID NO: 2616 - protein, 107 aa, Artificial Sequence
  synthetic polypeptide
DIQMTQSPSSLSASVGDRVTITCRASQSILSYVNWYQQKPGKAPKLVIYAATSLASGVPSRFSGSGSGTDFTLTISSLQPEDFATYYCQQSYDLPLTFGGGTKVEIK

SEQ ID NO: 2617 - protein, 107 aa, Artificial Sequence; identical to SEQ ID NO: 2481
  synthetic polypeptide

SEQ ID NO: 2618 - protein, 107 aa, Artificial Sequence
  synthetic polypeptide
DIQMTQSPSSLSASVGDRVTITCRASQSIITYVNWYQQKPGKAPKLVIYATTSLASGVPSRFSGSGSGTDFTLTISSLQPEDFATYYCQQSYSSPLTFGGGTKVEIK

SEQ ID NO: 2619 - protein, 107 aa, Artificial Sequence [sequence omitted]

SEQ ID NO: 2620 - protein, 107 aa, Artificial Sequence; identical to SEQ ID NO: 2562
  synthetic polypeptide

SEQ ID NO: 2621 - protein, 107 aa, Artificial Sequence
  synthetic polypeptide
DIQMTQSPSSLSASVGDRVTITCRASQSISYYLNWYQQKPGKAPKLLIYAVTSRASGVPSRFSGSGSGTDFTLTISSLQPEDFATYYCQQSYDNPLTFGGGTKVEIK

SEQ ID NO: 2622 - protein, 107 aa, Artificial Sequence
  synthetic polypeptide
DIQMTQSPSSLSASVGDRVTITCRASQSIITYLNWYQQKPGKAPKLVIYYVSNLPSGVPSRFSGSGSGTDFTLTISSLQPEDFATYYCQQSYDSPLTFGGGTKVEIK

SEQ ID NO: 2623 - protein, 107 aa, Artificial Sequence; identical to SEQ ID NO: 537
  synthetic polypeptide

SEQ ID NO: 2624 - protein, 6 aa, Artificial Sequence
  synthetic polypeptide
SSYSMN

SEQ ID NO: 2625 - protein, 6 aa, Artificial Sequence
  synthetic polypeptide
DDYGMN

SEQ ID NO: 2626 - protein, 6 aa, Artificial Sequence
  synthetic polypeptide
SSYGMH

SEQ ID NO: 2627 - protein, 6 aa, Artificial Sequence
  synthetic polypeptide
DSYGMH

SEQ ID NO: 2628 - protein, 6 aa, Artificial Sequence
  synthetic polypeptide
DSYGMH

SEQ ID NO: 2629 - protein, 6 aa, Artificial Sequence
  synthetic polypeptide
SSYGMH

SEQ ID NO: 2630 - protein, 6 aa, Artificial Sequence
  synthetic polypeptide
SSYGMH

SEQ ID NO: 2631 - protein, 6 aa, Artificial Sequence
  synthetic polypeptide
DSYGMN

SEQ ID NO: 2632 - protein, 6 aa, Artificial Sequence
  synthetic polypeptide
SSYGMH

SEQ ID NO: 2633 - protein, 6 aa, Artificial Sequence
  synthetic polypeptide
SSYSMN

SEQ ID NO: 2634 - protein, 6 aa, Artificial Sequence
  synthetic polypeptide
SSYGMN

SEQ ID NO: 2635 - protein, 6 aa, Artificial Sequence
  synthetic polypeptide
SSYGMH

SEQ ID NO: 2636 - protein, 6 aa, Artificial Sequence
  synthetic polypeptide
DSYGMN

SEQ ID NO: 2637 - protein, 6 aa, Artificial Sequence
  synthetic polypeptide
DSYGMN

SEQ ID NO: 2638 - protein, 6 aa, Artificial Sequence
  synthetic polypeptide
SDYSMN

SEQ ID NO: 2639 - protein, 6 aa, Artificial Sequence
  synthetic polypeptide
SSYGMH

SEQ ID NO: 2640 - protein, 6 aa, Artificial Sequence
  synthetic polypeptide
DSYGMH

SEQ ID NO: 2641 - protein, 6 aa, Artificial Sequence
  synthetic polypeptide
SSYGMH

SEQ ID NO: 2642 - protein, 6 aa, Artificial Sequence
  synthetic polypeptide
DSYSMN

SEQ ID NO: 2643 - protein, 6 aa, Artificial Sequence
  synthetic polypeptide
SSYGMN

SEQ ID NO: 2644 - protein, 6 aa, Artificial Sequence
  synthetic polypeptide
SDYSMN

SEQ ID NO: 2645 - protein, 6 aa, Artificial Sequence
  synthetic polypeptide
DSYGMN

SEQ ID NO: 2646 - protein, 6 aa, Artificial Sequence
  synthetic polypeptide
SSYGMN

SEQ ID NO: 2647 - protein, 6 aa, Artificial Sequence
  synthetic polypeptide
SDYGMN

SEQ ID NO: 2648 - protein, 6 aa, Artificial Sequence
  synthetic polypeptide
DDYGMN

SEQ ID NO: 2649 - protein, 6 aa, Artificial Sequence
  synthetic polypeptide
SSYGMN

SEQ ID NO: 2650 - protein, 6 aa, Artificial Sequence
  synthetic polypeptide
DSYGMN

SEQ ID NO: 2651 - protein, 6 aa, Artificial Sequence
  synthetic polypeptide
SSYSMN

SEQ ID NO: 2652 - protein, 6 aa, Artificial Sequence
  synthetic polypeptide
SSYSMN

SEQ ID NO: 2653 - protein, 6 aa, Artificial Sequence
  synthetic polypeptide
SSYGMH

SEQ ID NO: 2654 - protein, 6 aa, Artificial Sequence
  synthetic polypeptide
DSYGMN

SEQ ID NO: 2655 - protein, 6 aa, Artificial Sequence
  synthetic polypeptide
SSYGMN

SEQ ID NO: 2656 - protein, 6 aa, Artificial Sequence
  synthetic polypeptide
SSYSMN

SEQ ID NO: 2657 - protein, 6 aa, Artificial Sequence
  synthetic polypeptide
SSYSMN

SEQ ID NO: 2658 - protein, 6 aa, Artificial Sequence
  synthetic polypeptide
DSYGMN

SEQ ID NO: 2659 - protein, 6 aa, Artificial Sequence
  synthetic polypeptide
SDYGMN

SEQ ID NO: 2660 - protein, 6 aa, Artificial Sequence
  synthetic polypeptide
SSYSMN

SEQ ID NO: 2661 - protein, 6 aa, Artificial Sequence
  synthetic polypeptide
SDYSMN

SEQ ID NO: 2662 - protein, 6 aa, Artificial Sequence
  synthetic polypeptide
SSYSMN

SEQ ID NO: 2663 - protein, 6 aa, Artificial Sequence
  synthetic polypeptide
DSYGMN

SEQ ID NO: 2664 - protein, 6 aa, Artificial Sequence
  synthetic polypeptide
SSYGMN

SEQ ID NO: 2665 - protein, 6 aa, Artificial Sequence
  synthetic polypeptide
SSYGMH

SEQ ID NO: 2666 - protein, 6 aa, Artificial Sequence
  synthetic polypeptide
SDYGMN

SEQ ID NO: 2667 - protein, 6 aa, Artificial Sequence
  synthetic polypeptide
DSYGMN

SEQ ID NO: 2668 - protein, 6 aa, Artificial Sequence
  synthetic polypeptide
SSYSMN

SEQ ID NO: 2669 - protein, 6 aa, Artificial Sequence
  synthetic polypeptide
SDYGMN

SEQ ID NO: 2670 - protein, 6 aa, Artificial Sequence
  synthetic polypeptide
DSYGMN

SEQ ID NO: 2671 - protein, 6 aa, Artificial Sequence
  synthetic polypeptide
SSYGMN

SEQ ID NO: 2672 - protein, 6 aa, Artificial Sequence
  synthetic polypeptide
SDYSMN

SEQ ID NO: 2673 - protein, 6 aa, Artificial Sequence
  synthetic polypeptide
SDYGMN

SEQ ID NO: 2674 - protein, 6 aa, Artificial Sequence
  synthetic polypeptide
DDYSMN

SEQ ID NO: 2675 - protein, 6 aa, Artificial Sequence
  synthetic polypeptide
DDYGMN

SEQ ID NO: 2676 - protein, 6 aa, Artificial Sequence
  synthetic polypeptide
DSYSMN

SEQ ID NO: 2677 - protein, 6 aa, Artificial Sequence
  synthetic polypeptide
DSYGMN

SEQ ID NO: 2678 - protein, 6 aa, Artificial Sequence
  synthetic polypeptide
SSYGMN

SEQ ID NO: 2679 - protein, 6 aa, Artificial Sequence
  synthetic polypeptide
SDYSMN

SEQ ID NO: 2680 - protein, 6 aa, Artificial Sequence
  synthetic polypeptide
DSYSMN

SEQ ID NO: 2681 - protein, 6 aa, Artificial Sequence
  synthetic polypeptide
SDYGMN

SEQ ID NO: 2682 - protein, 6 aa, Artificial Sequence
  synthetic polypeptide
DSYGMN

SEQ ID NO: 2683 - protein, 6 aa, Artificial Sequence
  synthetic polypeptide
SSYSMN

SEQ ID NO: 2684 - protein, 6 aa, Artificial Sequence
  synthetic polypeptide
DSYGMH

SEQ ID NO: 2685 - protein, 6 aa, Artificial Sequence
  synthetic polypeptide
SSYSMN

SEQ ID NO: 2686 - protein, 6 aa, Artificial Sequence
  synthetic polypeptide
SDYGMN

SEQ ID NO: 2687 - protein, 6 aa, Artificial Sequence
  synthetic polypeptide
SSYGMN

SEQ ID NO: 2688 - protein, 6 aa, Artificial Sequence
  synthetic polypeptide
DDYGMN

SEQ ID NO: 2689 - protein, 6 aa, Artificial Sequence
  synthetic polypeptide
SSYGMN

SEQ ID NO: 2690 - protein, 6 aa, Artificial Sequence
  synthetic polypeptide
SSYGMN

SEQ ID NO: 2691 - protein, 6 aa, Artificial Sequence
  synthetic polypeptide
SSYGMN

SEQ ID NO: 2692 - protein, 6 aa, Artificial Sequence
  synthetic polypeptide
SSYSMN

SEQ ID NO: 2693 - protein, 6 aa, Artificial Sequence
  synthetic polypeptide
SSYSMN

SEQ ID NO: 2694 - protein, 6 aa, Artificial Sequence
  synthetic polypeptide
DSYSMN

SEQ ID NO: 2695 - protein, 6 aa, Artificial Sequence
  synthetic polypeptide
SSYGMN

SEQ ID NO: 2696 - protein, 6 aa, Artificial Sequence
  synthetic polypeptide
DSYGMH

SEQ ID NO: 2697 - protein, 6 aa, Artificial Sequence
  synthetic polypeptide
SDYSMN

SEQ ID NO: 2698 - protein, 6 aa, Artificial Sequence
  synthetic polypeptide
DSYGMN

SEQ ID NO: 2699 - protein, 6 aa, Artificial Sequence
  synthetic polypeptide
SSYGMH

SEQ ID NO: 2700 - protein, 6 aa, Artificial Sequence
  synthetic polypeptide
SSYGMN

SEQ ID NO: 2701 - protein, 6 aa, Artificial Sequence
  synthetic polypeptide
SSYSMN

SEQ ID NO: 2702 - protein, 6 aa, Artificial Sequence
  synthetic polypeptide
DDYGMN

SEQ ID NO: 2703 - protein, 6 aa, Artificial Sequence
  synthetic polypeptide
SSYSMN

SEQ ID NO: 2704 - protein, 6 aa, Artificial Sequence
  synthetic polypeptide
DSYSMN

SEQ ID NO: 2705 - protein, 6 aa, Artificial Sequence
  synthetic polypeptide
SSYSMN

SEQ ID NO: 2706 - protein, 6 aa, Artificial Sequence
  synthetic polypeptide
SDYGMH

SEQ ID NO: 2707 - protein, 6 aa, Artificial Sequence
  synthetic polypeptide
SSYGMN

SEQ ID NO: 2708 - protein, 6 aa, Artificial Sequence
  synthetic polypeptide
DSYSMN

SEQ ID NO: 2709 - protein, 6 aa, Artificial Sequence
  synthetic polypeptide
SDYGMN

SEQ ID NO: 2710 - protein, 6 aa, Artificial Sequence
  synthetic polypeptide
SDYGMH

SEQ ID NO: 2711 - protein, 6 aa, Artificial Sequence
  synthetic polypeptide
SSYGMN

SEQ ID NO: 2712 - protein, 6 aa, Artificial Sequence
  synthetic polypeptide
SSYSMN

SEQ ID NO: 2713 - protein, 6 aa, Artificial Sequence
  synthetic polypeptide
SSYSMN

SEQ ID NO: 2714 - protein, 6 aa, Artificial Sequence
  synthetic polypeptide
SSYGMN

SEQ ID NO: 2715 - protein, 6 aa, Artificial Sequence
  synthetic polypeptide
SSYSMN

SEQ ID NO: 2716 - protein, 6 aa, Artificial Sequence
  synthetic polypeptide
DSYSMN

SEQ ID NO: 2717 - protein, 6 aa, Artificial Sequence
  synthetic polypeptide
SSYGMN

SEQ ID NO: 2718 - protein, 6 aa, Artificial Sequence
  synthetic polypeptide
SSYSMN

SEQ ID NO: 2719 - protein, 6 aa, Artificial Sequence
  synthetic polypeptide
SDYGMN

SEQ ID NO: 2720 - protein, 6 aa, Artificial Sequence
  synthetic polypeptide
SDYSMN

SEQ ID NO: 2721 - protein, 6 aa, Artificial Sequence
  synthetic polypeptide
DSYGMN

SEQ ID NO: 2722 - protein, 6 aa, Artificial Sequence
  synthetic polypeptide
DSYSMN

SEQ ID NO: 2723 - protein, 6 aa, Artificial Sequence
  synthetic polypeptide
DSYGMN

SEQ ID NO: 2724 - protein, 6 aa, Artificial Sequence
  synthetic polypeptide
SSYGMN

SEQ ID NO: 2725 - protein, 6 aa, Artificial Sequence
  synthetic polypeptide
SSYGMH

SEQ ID NO: 2726 - protein, 6 aa, Artificial Sequence
  synthetic polypeptide
SSYGMN

SEQ ID NO: 2727 - protein, 6 aa, Artificial Sequence
  synthetic polypeptide
SSYGMN

SEQ ID NO: 2728 - protein, 6 aa, Artificial Sequence
  synthetic polypeptide
SDYGMN

SEQ ID NO: 2729 - protein, 6 aa, Artificial Sequence
  synthetic polypeptide
DDYSMN

SEQ ID NO: 2730 - protein, 6 aa, Artificial Sequence
  synthetic polypeptide
DSYGMN

SEQ ID NO: 2731 - protein, 6 aa, Artificial Sequence
  synthetic polypeptide
DSYGMN

SEQ ID NO: 2732 - protein, 6 aa, Artificial Sequence
  synthetic polypeptide
SSYSMN

SEQ ID NO: 2733 - protein, 6 aa, Artificial Sequence
  synthetic polypeptide
DSYSMN

SEQ ID NO: 2734 - protein, 6 aa, Artificial Sequence
  synthetic polypeptide
DSYGMN

SEQ ID NO: 2735 - protein, 6 aa, Artificial Sequence
  synthetic polypeptide
SSYSMN

SEQ ID NO: 2736 - protein, 6 aa, Artificial Sequence
  synthetic polypeptide
SSYSMN

SEQ ID NO: 2737 - protein, 6 aa, Artificial Sequence
  synthetic polypeptide
SSYGMN

SEQ ID NO: 2738 - protein, 6 aa, Artificial Sequence
  synthetic polypeptide
SSYGMN

SEQ ID NO: 2739 - protein, 6 aa, Artificial Sequence
  synthetic polypeptide
DDYSMN

SEQ ID NO: 2740 - protein, 6 aa, Artificial Sequence
  synthetic polypeptide
SSYSMN

SEQ ID NO: 2741 - protein, 6 aa, Artificial Sequence
  synthetic polypeptide
SSYSMN

SEQ ID NO: 2742 - protein, 6 aa, Artificial Sequence
  synthetic polypeptide
DSYSMN

SEQ ID NO: 2743 - protein, 6 aa, Artificial Sequence
  synthetic polypeptide
SSYGMN

SEQ ID NO: 2744 - protein, 6 aa, Artificial Sequence
  synthetic polypeptide
DSYSMN

SEQ ID NO: 2745 - protein, 6 aa, Artificial Sequence
  synthetic polypeptide
SSYGMN

SEQ ID NO: 2746 - protein, 6 aa, Artificial Sequence
  synthetic polypeptide
SSYSMN

SEQ ID NO: 2747 - protein, 6 aa, Artificial Sequence
  synthetic polypeptide
SSYGMN

SEQ ID NO: 2748 - protein, 6 aa, Artificial Sequence
  synthetic polypeptide
DSYGMN

SEQ ID NO: 2749 - protein, 6 aa, Artificial Sequence
  synthetic polypeptide
DSYSMN

SEQ ID NO: 2750 - protein, 6 aa, Artificial Sequence
  synthetic polypeptide
DSYSMN

SEQ ID NO: 2751 - protein, 6 aa, Artificial Sequence
  synthetic polypeptide
SSYGMN

SEQ ID NO: 2752 - protein, 6 aa, Artificial Sequence
  synthetic polypeptide
SSYGMN

SEQ ID NO: 2753 - protein, 6 aa, Artificial Sequence
  synthetic polypeptide
DDSSMH

SEQ ID NO: 2754 - protein, 6 aa, Artificial Sequence
  synthetic polypeptide
SSYGMN

SEQ ID NO: 2755 - protein, 6 aa, Artificial Sequence
  synthetic polypeptide
DSYSMN

SEQ ID NO: 2756 - protein, 6 aa, Artificial Sequence
  synthetic polypeptide
SSYSMN

SEQ ID NO: 2757 - protein, 6 aa, Artificial Sequence
  synthetic polypeptide
SDYSMN

SEQ ID NO: 2758 - protein, 6 aa, Artificial Sequence
  synthetic polypeptide
SSYSMN

SEQ ID NO: 2759 - protein, 6 aa, Artificial Sequence
  synthetic polypeptide
SDYGMH

SEQ ID NO: 2760 - protein, 6 aa, Artificial Sequence
  synthetic polypeptide
SSYGMN

SEQ ID NO: 2761 - protein, 6 aa, Artificial Sequence
  synthetic polypeptide
SDYGMN

SEQ ID NO: 2762 - protein, 6 aa, Artificial Sequence
  synthetic polypeptide
SSYSMN

SEQ ID NO: 2763 - protein, 6 aa, Artificial Sequence
  synthetic polypeptide
SSYSMN

SEQ ID NO: 2764 - protein, 6 aa, Artificial Sequence
  synthetic polypeptide
SSYGMN

SEQ ID NO: 2765 - protein, 6 aa, Artificial Sequence
  synthetic polypeptide
SDYGMN

SEQ ID NO: 2766 - protein, 6 aa, Artificial Sequence
  synthetic polypeptide
SSYGMN

SEQ ID NO: 2767 - protein, 6 aa, Artificial Sequence
  synthetic polypeptide
SDYSMN

SEQ ID NO: 2768 - protein, 6 aa, Artificial Sequence
  synthetic polypeptide
SSYGMH

SEQ ID NO: 2769 - protein, 6 aa, Artificial Sequence
  synthetic polypeptide
DSYSMN

SEQ ID NO: 2770 - protein, 6 aa, Artificial Sequence
  synthetic polypeptide
DSYSMN

SEQ ID NO: 2771 - protein, 6 aa, Artificial Sequence
  synthetic polypeptide
DSYSMN

SEQ ID NO: 2772 - protein, 6 aa, Artificial Sequence
  synthetic polypeptide
SSYSMN

SEQ ID NO: 2773 - protein, 6 aa, Artificial Sequence
  synthetic polypeptide
DDYSMN

SEQ ID NO: 2774 - protein, 6 aa, Artificial Sequence
  synthetic polypeptide
SSYSMN

SEQ ID NO: 2775 - protein, 6 aa, Artificial Sequence
  synthetic polypeptide
SSYSMN

SEQ ID NO: 2776 - protein, 6 aa, Artificial Sequence
  synthetic polypeptide
DSYSMN

SEQ ID NO: 2777 - protein, 6 aa, Artificial Sequence
  synthetic polypeptide
DSYSMN

SEQ ID NO: 2778 - protein, 6 aa, Artificial Sequence
  synthetic polypeptide
DDYSMN

SEQ ID NO: 2779 - protein, 6 aa, Artificial Sequence
  synthetic polypeptide
DSYSMN

SEQ ID NO: 2780 - protein, 6 aa, Artificial Sequence
  synthetic polypeptide
SSYSMN

SEQ ID NO: 2781 - protein, 6 aa, Artificial Sequence
  synthetic polypeptide
DSYSMN

SEQ ID NO: 2782 - protein, 6 aa, Artificial Sequence
  synthetic polypeptide
DSYSMN

SEQ ID NO: 2783 - protein, 6 aa, Artificial Sequence
  synthetic polypeptide
DSYGMN

SEQ ID NO: 2784 - protein, 6 aa, Artificial Sequence
  synthetic polypeptide
SDYSMN

SEQ ID NO: 2785 - protein, 6 aa, Artificial Sequence
  synthetic polypeptide
SSYGMH

SEQ ID NO: 2786 - protein, 6 aa, Artificial Sequence
  synthetic polypeptide
SSYGMN

SEQ ID NO: 2787 - protein, 6 aa, Artificial Sequence
  synthetic polypeptide
SDYGMN

SEQ ID NO: 2788 - protein, 6 aa, Artificial Sequence
  synthetic polypeptide
SDYSMN

SEQ ID NO: 2789 - protein, 6 aa, Artificial Sequence
  synthetic polypeptide
DSYSMN

SEQ ID NO: 2790 - protein, 6 aa, Artificial Sequence
  synthetic polypeptide
DSYGMN

SEQ ID NO: 2791 - protein, 6 aa, Artificial Sequence
  synthetic polypeptide
DSYGMN

SEQ ID NO: 2792 - protein, 6 aa, Artificial Sequence
  synthetic polypeptide
SSYGMN

SEQ ID NO: 2793 - protein, 6 aa, Artificial Sequence
  synthetic polypeptide
SSYGMN

SEQ ID NO: 2794 - protein, 6 aa, Artificial Sequence
  synthetic polypeptide
SDYSMN

SEQ ID NO: 2795 - protein, 6 aa, Artificial Sequence
  synthetic polypeptide
DSYGMN

SEQ ID NO: 2796 - protein, 6 aa, Artificial Sequence
  synthetic polypeptide
DSYGMN

SEQ ID NO: 2797 - protein, 6 aa, Artificial Sequence
  synthetic polypeptide
DDYSMN

SEQ ID NO: 2798 - protein, 6 aa, Artificial Sequence
  synthetic polypeptide
SSYSMN

SEQ ID NO: 2799 - protein, 6 aa, Artificial Sequence
  synthetic polypeptide
SSYSMN

SEQ ID NO: 2800 - protein, 6 aa, Artificial Sequence
  synthetic polypeptide
SSYSMN

SEQ ID NO: 2801 - protein, 6 aa, Artificial Sequence
  synthetic polypeptide
SSYSMN

SEQ ID NO: 2802 - protein, 6 aa, Artificial Sequence
  synthetic polypeptide
DSYSMN

SEQ ID NO: 2803 - protein, 6 aa, Artificial Sequence
  synthetic polypeptide
DSYSMN

SEQ ID NO: 2804 - protein, 6 aa, Artificial Sequence
  synthetic polypeptide
SSYSMN

SEQ ID NO: 2805 - protein, 6 aa, Artificial Sequence
  synthetic polypeptide
SSYSMN

SEQ ID NO: 2806 - protein, 6 aa, Artificial Sequence
  synthetic polypeptide
DSYSMN

SEQ ID NO: 2807 - protein, 6 aa, Artificial Sequence
  synthetic polypeptide
SSYGMN

SEQ ID NO: 2808 - protein, 6 aa, Artificial Sequence
  synthetic polypeptide
DSYGMN

SEQ ID NO: 2809 - protein, 6 aa, Artificial Sequence
  synthetic polypeptide
SSYGMN

SEQ ID NO: 2810 - protein, 6 aa, Artificial Sequence
  synthetic polypeptide
SSYSMN

SEQ ID NO: 2811 - protein, 6 aa, Artificial Sequence
  synthetic polypeptide
SDYGMN

SEQ ID NO: 2812 - protein, 6 aa, Artificial Sequence
  synthetic polypeptide
SSYSMN

SEQ ID NO: 2813 - protein, 6 aa, Artificial Sequence
  synthetic polypeptide
DSYSMN

SEQ ID NO: 2814 - protein, 6 aa, Artificial Sequence
  synthetic polypeptide
SDYSMN

SEQ ID NO: 2815 - protein, 6 aa, Artificial Sequence
  synthetic polypeptide
SSYSMN

SEQ ID NO: 2816 - protein, 6 aa, Artificial Sequence
  synthetic polypeptide
SSYSMN

SEQ ID NO: 2817 - protein, 6 aa, Artificial Sequence
  synthetic polypeptide
DSYSMN

SEQ ID NO: 2818 - protein, 6 aa, Artificial Sequence
  synthetic polypeptide
DSYSMN

SEQ ID NO: 2819 - protein, 6 aa, Artificial Sequence
  synthetic polypeptide
DSYSMN

SEQ ID NO: 2820 - protein, 6 aa, Artificial Sequence
  synthetic polypeptide
DDYSMN

SEQ ID NO: 2821 - protein, 6 aa, Artificial Sequence
  synthetic polypeptide
DSYSMN

SEQ ID NO: 2822 - protein, 6 aa, Artificial Sequence
  synthetic polypeptide
DSYGMN

SEQ ID NO: 2823 - protein, 6 aa, Artificial Sequence
  synthetic polypeptide
SSYGMN

SEQ ID NO: 2824 - protein, 6 aa, Artificial Sequence
  synthetic polypeptide
SSYSMN

SEQ ID NO: 2825 - protein, 6 aa, Artificial Sequence
  synthetic polypeptide
SSYSMN

SEQ ID NO: 2826 - protein, 6 aa, Artificial Sequence
  synthetic polypeptide
SDYSMN

SEQ ID NO: 2827 - protein, 6 aa, Artificial Sequence
  synthetic polypeptide
SSYGMN

SEQ ID NO: 2828 - protein, 6 aa, Artificial Sequence
  synthetic polypeptide
SSYGMN

SEQ ID NO: 2829 - protein, 6 aa, Artificial Sequence
  synthetic polypeptide
DSYSMN

SEQ ID NO: 2830 - protein, 6 aa, Artificial Sequence
  synthetic polypeptide
DSYSMN

SEQ ID NO: 2831 - protein, 6 aa, Artificial Sequence
  synthetic polypeptide
SSYGMN

SEQ ID NO: 2832 - protein, 6 aa, Artificial Sequence
  synthetic polypeptide
SSYSMN

SEQ ID NO: 2833 - protein, 6 aa, Artificial Sequence
  synthetic polypeptide
DSYSMN

SEQ ID NO: 2834 - protein, 6 aa, Artificial Sequence
  synthetic polypeptide
SSYSMN

SEQ ID NO: 2835 - protein, 6 aa, Artificial Sequence
  synthetic polypeptide
SSYGMH

SEQ ID NO: 2836 - protein, 6 aa, Artificial Sequence
  synthetic polypeptide
SSYSMN

SEQ ID NO: 2837 - protein, 6 aa, Artificial Sequence
  synthetic polypeptide
SSYGMN

SEQ ID NO: 2838 - protein, 6 aa, Artificial Sequence
  synthetic polypeptide
DSYSMN

SEQ ID NO: 2839 - protein, 6 aa, Artificial Sequence
  synthetic polypeptide
SSYGMN

SEQ ID NO: 2840 - protein, 6 aa, Artificial Sequence
  synthetic polypeptide
DSYGMN

SEQ ID NO: 2841 - protein, 6 aa, Artificial Sequence
  synthetic polypeptide
SSYSMN

SEQ ID NO: 2842 - protein, 6 aa, Artificial Sequence
  synthetic polypeptide
SSYGMN

SEQ ID NO: 2843 - protein, 6 aa, Artificial Sequence
  synthetic polypeptide
DDYGMH

SEQ ID NO: 2844 - protein, 6 aa, Artificial Sequence
  synthetic polypeptide
DDSSMH

SEQ ID NO: 2845 - protein, 6 aa, Artificial Sequence
  synthetic polypeptide
SSYSMN

SEQ ID NO: 2846 - protein, 6 aa, Artificial Sequence
  synthetic polypeptide
SSYGMN

SEQ ID NO: 2847 - protein, 6 aa, Artificial Sequence
  synthetic polypeptide
SDYGMN

SEQ ID NO: 2848 - protein, 6 aa, Artificial Sequence
  synthetic polypeptide
DSYGMN

SEQ ID NO: 2849 - protein, 6 aa, Artificial Sequence
  synthetic polypeptide
SSYSMN

SEQ ID NO: 2850 - protein, 6 aa, Artificial Sequence
  synthetic polypeptide
SDYSMN

SEQ ID NO: 2851 - protein, 6 aa, Artificial Sequence
  synthetic polypeptide
SSYGMN

SEQ ID NO: 2852 - protein, 6 aa, Artificial Sequence
  synthetic polypeptide
DSYSMN

SEQ ID NO: 2853 - protein, 6 aa, Artificial Sequence
  synthetic polypeptide
SDYGMN

SEQ ID NO: 2854 - protein, 6 aa, Artificial Sequence
  synthetic polypeptide
SSYSMN

SEQ ID NO: 2855 - protein, 6 aa, Artificial Sequence
  synthetic polypeptide
DSYGMH

SEQ ID NO: 2856 - protein, 6 aa, Artificial Sequence
  synthetic polypeptide
SSYSMN

SEQ ID NO: 2857 - protein, 6 aa, Artificial Sequence
  synthetic polypeptide
DSYSMN

SEQ ID NO: 2858 - protein, 6 aa, Artificial Sequence
  synthetic polypeptide
SSYSMN

SEQ ID NO: 2859 - protein, 6 aa, Artificial Sequence
  synthetic polypeptide
DSYSMN

SEQ ID NO: 2860 - protein, 6 aa, Artificial Sequence
  synthetic polypeptide
DSYGMN

SEQ ID NO: 2861 - protein, 6 aa, Artificial Sequence
  synthetic polypeptide
SSYSMN

SEQ ID NO: 2862 - protein, 6 aa, Artificial Sequence
  synthetic polypeptide
SSYSMN

SEQ ID NO: 2863 - protein, 6 aa, Artificial Sequence
  synthetic polypeptide
SSYGMN

SEQ ID NO: 2864 - protein, 6 aa, Artificial Sequence
  synthetic polypeptide
SSYGMN

SEQ ID NO: 2865 - protein, 6 aa, Artificial Sequence
  synthetic polypeptide
SDYGMN

SEQ ID NO: 2866 - protein, 6 aa, Artificial Sequence
  synthetic polypeptide
DSYGMN

SEQ ID NO: 2867 - protein, 6 aa, Artificial Sequence
  synthetic polypeptide
DSYSMN

SEQ ID NO: 2868 - protein, 6 aa, Artificial Sequence
  synthetic polypeptide
DSYGMN

SEQ ID NO: 2869 - protein, 6 aa, Artificial Sequence
  synthetic polypeptide
DSYSMN

SEQ ID NO: 2870 - protein, 6 aa, Artificial Sequence
  synthetic polypeptide
SDYSMN

SEQ ID NO: 2871 - protein, 6 aa, Artificial Sequence
  synthetic polypeptide
DSYSMN

SEQ ID NO: 2872 - protein, 13 aa, Artificial Sequence
  synthetic polypeptide
WVAGINYNSGYKG

SEQ ID NO: 2873 - protein, 13 aa, Artificial Sequence
  synthetic polypeptide
WVSGINYNSGYTS

SEQ ID NO: 2874 - protein, 13 aa, Artificial Sequence
  synthetic polypeptide
WVAGINYNGGYTS

SEQ ID NO: 2875 - protein, 13 aa, Artificial Sequence
  synthetic polypeptide
WVASINYNSGYTS

SEQ ID NO: 2876 - protein, 13 aa, Artificial Sequence
  synthetic polypeptide
WVSNINYNGGYKS

SEQ ID NO: 2877 - protein, 13 aa, Artificial Sequence
  synthetic polypeptide
WVASINYNSGYTS

SEQ ID NO: 2878 - protein, 13 aa, Artificial Sequence
  synthetic polypeptide
WVAGINYNGGYTS

SEQ ID NO: 2879 - protein, 13 aa, Artificial Sequence
  synthetic polypeptide
WVSSINYNSGYKS

SEQ ID NO: 2880 - protein, 13 aa, Artificial Sequence
  synthetic polypeptide
WVASINYNGGYTS

SEQ ID NO: 2881 - protein, 13 aa, Artificial Sequence
  synthetic polypeptide
WVAGINYNGGYKS

SEQ ID NO: 2882 - protein, 13 aa, Artificial Sequence
  synthetic polypeptide
WVAGINYNSGYKS

SEQ ID NO: 2883 - protein, 13 aa, Artificial Sequence
  synthetic polypeptide
WVSGINYNSGYTS

SEQ ID NO: 2884 - protein, 13 aa, Artificial Sequence
  synthetic polypeptide
WVSNINYNSGYTS

SEQ ID NO: 2885 - protein, 13 aa, Artificial Sequence
  synthetic polypeptide
WVSNINYNGGYTG

SEQ ID NO: 2886 - protein, 13 aa, Artificial Sequence
  synthetic polypeptide
WVSGINYNSGYKG

SEQ ID NO: 2887 - protein, 13 aa, Artificial Sequence
  synthetic polypeptide
WVAGINYNGGYTS

SEQ ID NO: 2888 - protein, 13 aa, Artificial Sequence
  synthetic polypeptide
WVSGINYNSGYTS

SEQ ID NO: 2889 - protein, 13 aa, Artificial Sequence
  synthetic polypeptide
WVASINYNSGYKS

SEQ ID NO: 2890 - protein, 13 aa, Artificial Sequence
  synthetic polypeptide
WVSGINYNSGYKG

SEQ ID NO: 2891 - protein, 13 aa, Artificial Sequence
  synthetic polypeptide
WVAGINYNSGYKS

SEQ ID NO: 2892 - protein, 13 aa, Artificial Sequence
  synthetic polypeptide
WVSGINYNGGYTS

SEQ ID NO: 2893 - protein, 13 aa, Artificial Sequence
  synthetic polypeptide
WVAGINYNSGYKS

SEQ ID NO: 2894 - protein, 13 aa, Artificial Sequence
  synthetic polypeptide
WVANINYNGGYTG

SEQ ID NO: 2895 - protein, 13 aa, Artificial Sequence
  synthetic polypeptide
WVSSINYNGGYTG

SEQ ID NO: 2896 - protein, 13 aa, Artificial Sequence
  synthetic polypeptide
WVAGINYNGGYKS

SEQ ID NO: 2897 - protein, 13 aa, Artificial Sequence
  synthetic polypeptide
WVSGINYNSGYTG

SEQ ID NO: 2898 - protein, 13 aa, Artificial Sequence
  synthetic polypeptide
WVAGINYNSGYKS

SEQ ID NO: 2899 - protein, 13 aa, Artificial Sequence
  synthetic polypeptide
WVSGINYNSGYTG

SEQ ID NO: 2900 - protein, 13 aa, Artificial Sequence
  synthetic polypeptide
WVSNINYNGGYKS

SEQ ID NO: 2901 - protein, 13 aa, Artificial Sequence
  synthetic polypeptide
WVASINYNGGYTG

SEQ ID NO: 2902 - protein, 13 aa, Artificial Sequence
  synthetic polypeptide
WVSNINYNGGYKG

SEQ ID NO: 2903 - protein, 13 aa, Artificial Sequence
  synthetic polypeptide
WVSGINYNSGYTS

SEQ ID NO: 2904 - protein, 13 aa, Artificial Sequence
  synthetic polypeptide
WVAGINYNSGYKG

SEQ ID NO: 2905 - protein, 13 aa, Artificial Sequence
  synthetic polypeptide
WVSGINYNGGYTS

SEQ ID NO: 2906 - protein, 13 aa, Artificial Sequence
  synthetic polypeptide
WVSGINYNGGYKG

SEQ ID NO: 2907 - protein, 13 aa, Artificial Sequence
  synthetic polypeptide
WVSGINYNGGYTS

SEQ ID NO: 2908 - protein, 13 aa, Artificial Sequence
  synthetic polypeptide
WVANINYNSGYKS

SEQ ID NO: 2909 - protein, 13 aa, Artificial Sequence
  synthetic polypeptide
WVAGINYNSGYTS

SEQ ID NO: 2910 - protein, 13 aa, Artificial Sequence
  synthetic polypeptide
WVSGINYNSGYTS

SEQ ID NO: 2911 - protein, 13 aa, Artificial Sequence
  synthetic polypeptide
WVSNINYNGGYTS

SEQ ID NO: 2912 - protein, 13 aa, Artificial Sequence
  synthetic polypeptide
WVSSINYNGGYTG

SEQ ID NO: 2913 - protein, 13 aa, Artificial Sequence
  synthetic polypeptide
WVSGINYNGGYTS

SEQ ID NO: 2914 - protein, 13 aa, Artificial Sequence
  synthetic polypeptide
WVASINYNSGYTS

SEQ ID NO: 2915 - protein, 13 aa, Artificial Sequence
  synthetic polypeptide
WVSNINYNSGYKG

SEQ ID NO: 2916 - protein, 13 aa, Artificial Sequence
  synthetic polypeptide
WVSNINYNSGYKS

SEQ ID NO: 2917 - protein, 13 aa, Artificial Sequence
  synthetic polypeptide
WVSSINYNGGYKG

SEQ ID NO: 2918 - protein, 13 aa, Artificial Sequence
  synthetic polypeptide
WVSSINYNGGYTS

SEQ ID NO: 2919 - protein, 13 aa, Artificial Sequence
  synthetic polypeptide
WVAGINYNGGYKS

SEQ ID NO: 2920 - protein, 13 aa, Artificial Sequence
  synthetic polypeptide
WVAGINYNSGYTG

SEQ ID NO: 2921 - protein, 13 aa, Artificial Sequence
  synthetic polypeptide
WVSGINYNGGYKG

SEQ ID NO: 2922 - protein, 13 aa, Artificial Sequence
  synthetic polypeptide
WVSGINYNGGYKS

SEQ ID NO: 2923 - protein, 13 aa, Artificial Sequence
  synthetic polypeptide
WVSSINYNGGYTG

SEQ ID NO: 2924 - protein, 13 aa, Artificial Sequence
  synthetic polypeptide
WVSSINYNSGYTG

SEQ ID NO: 2925 - protein, 13 aa, Artificial Sequence
  synthetic polypeptide
WVSNINYNGGYTS

SEQ ID NO: 2926 - protein, 13 aa, Artificial Sequence
  synthetic polypeptide
WVAGINYNGGYKS

SEQ ID NO: 2927 - protein, 13 aa, Artificial Sequence
  synthetic polypeptide
WVSSINYNGGYKG

SEQ ID NO: 2928 - protein, 13 aa, Artificial Sequence
  synthetic polypeptide
WVSSINYNSGYKG

SEQ ID NO: 2929 - protein, 13 aa, Artificial Sequence
  synthetic polypeptide
WVASINYNSGYKG

SEQ ID NO: 2930 - protein, 13 aa, Artificial Sequence
  synthetic polypeptide
WVSSINYNSGYKG

SEQ ID NO: 2931 - protein, 13 aa, Artificial Sequence
  synthetic polypeptide
WVAGINYNSGYKS

SEQ ID NO: 2932 - protein, 13 aa, Artificial Sequence
  synthetic polypeptide
WVANINYNGGYTG

SEQ ID NO: 2933 - protein, 13 aa, Artificial Sequence
  synthetic polypeptide
WVAGINYNSGYTG

SEQ ID NO: 2934 - protein, 13 aa, Artificial Sequence
  synthetic polypeptide
WVANINYNGGYTS

SEQ ID NO: 2935 - protein, 13 aa, Artificial Sequence
  synthetic polypeptide
WVSGINYNSGYKS

SEQ ID NO: 2936 - protein, 13 aa, Artificial Sequence
  synthetic polypeptide
WVSGINYNGGYTS

SEQ ID NO: 2937 - protein, 13 aa, Artificial Sequence
  synthetic polypeptide
WVSNINYNGGYTG

SEQ ID NO: 2938 - protein, 13 aa, Artificial Sequence
  synthetic polypeptide
WVAGINYNGGYKG

SEQ ID NO: 2939 - protein, 13 aa, Artificial Sequence
  synthetic polypeptide
WVSNINYNGGYTS

SEQ ID NO: 2940 - protein, 13 aa, Artificial Sequence
  synthetic polypeptide
WVAGINYNSGYTG

SEQ ID NO: 2941 - protein, 13 aa, Artificial Sequence
  synthetic polypeptide
WVAGINYNSGYTS

SEQ ID NO: 2942 - protein, 13 aa, Artificial Sequence
  synthetic polypeptide
WVSGINYNGGYTS

SEQ ID NO: 2943 - protein, 13 aa, Artificial Sequence
  synthetic polypeptide
WVSGINYNSGYKS

SEQ ID NO: 2944 - protein, 13 aa, Artificial Sequence
  synthetic polypeptide
WVSGINYNSGYTS

SEQ ID NO: 2945 - protein, 13 aa, Artificial Sequence
  synthetic polypeptide
WVSNINYNGGYKS

SEQ ID NO: 2946 - protein, 13 aa, Artificial Sequence
  synthetic polypeptide
WVSGINYNSGYTS

SEQ ID NO: 2947 - protein, 13 aa, Artificial Sequence
  synthetic polypeptide
WVANINYNGGYTS

SEQ ID NO: 2948 - protein, 13 aa, Artificial Sequence
  synthetic polypeptide
WVSGINYNGGYKS

SEQ ID NO: 2949 - protein, 13 aa, Artificial Sequence
  synthetic polypeptide
WVSGINYNGGYTS

SEQ ID NO: 2950 - protein, 13 aa, Artificial Sequence
  synthetic polypeptide
WVSNINYNGGYKS

SEQ ID NO: 2951 - protein, 13 aa, Artificial Sequence
  synthetic polypeptide
WVASINYNSGYTG

SEQ ID NO: 2952 - protein, 13 aa, Artificial Sequence
  synthetic polypeptide
WVAGINYNSGYTS

SEQ ID NO: 2953 - protein, 13 aa, Artificial Sequence
  synthetic polypeptide
WVANINYNSGYTG

SEQ ID NO: 2954 - protein, 13 aa, Artificial Sequence
  synthetic polypeptide
WVSGINYNGGYTG

SEQ ID NO: 2955 - protein, 13 aa, Artificial Sequence
  synthetic polypeptide
WVAGINYNGGYTS

SEQ ID NO: 2956 - protein, 13 aa, Artificial Sequence
  synthetic polypeptide
WVAGINYNSGYTG

SEQ ID NO: 2957 - protein, 13 aa, Artificial Sequence
  synthetic polypeptide
WVSGINYNGGYTS

SEQ ID NO: 2958 - protein, 13 aa, Artificial Sequence
  synthetic polypeptide
WVASINYNSGYTS

SEQ ID NO: 2959 - protein, 13 aa, Artificial Sequence
  synthetic polypeptide
WVASINYNSGYTG

SEQ ID NO: 2960 - protein, 13 aa, Artificial Sequence
  synthetic polypeptide
WVAGINYNSGYKG

SEQ ID NO: 2961 - protein, 13 aa, Artificial Sequence
  synthetic polypeptide
WVAGINYNSGYTG

SEQ ID NO: 2962 - protein, 13 aa, Artificial Sequence
  synthetic polypeptide
WVSNINYNGGYTG

SEQ ID NO: 2963 - protein, 13 aa, Artificial Sequence
  synthetic polypeptide
WVSGINYNGGYTS

SEQ ID NO: 2964 - protein, 13 aa, Artificial Sequence
  synthetic polypeptide
WVSNINYNGGYKS

SEQ ID NO: 2965 - protein, 13 aa, Artificial Sequence
  synthetic polypeptide
WVSNINYNGGYKS

SEQ ID NO: 2966 - protein, 13 aa, Artificial Sequence
  synthetic polypeptide
WVSNINYNGGYTG

SEQ ID NO: 2967 - protein, 13 aa, Artificial Sequence
  synthetic polypeptide
WVASINYNGGYTG

SEQ ID NO: 2968 - protein, 13 aa, Artificial Sequence
  synthetic polypeptide
WVSNINYNSGYTG

SEQ ID NO: 2969 - protein, 13 aa, Artificial Sequence
  synthetic polypeptide
WVSGINYNGGYTS

SEQ ID NO: 2970 - protein, 13 aa, Artificial Sequence
  synthetic polypeptide
WVAGINYNSGYTS

SEQ ID NO: 2971 - protein, 13 aa, Artificial Sequence
  synthetic polypeptide
WVSNINYNGGYTG

SEQ ID NO: 2972 - protein, 13 aa, Artificial Sequence
  synthetic polypeptide
WVSNINYNGGYTS

SEQ ID NO: 2973 - protein, 13 aa, Artificial Sequence
  synthetic polypeptide
WVASINYNSGYTS

SEQ ID NO: 2974 - protein, 13 aa, Artificial Sequence
  synthetic polypeptide
WVSGINYNGGYKS

SEQ ID NO: 2975 - protein, 13 aa, Artificial Sequence
  synthetic polypeptide
WVASINYNSGYKS

SEQ ID NO: 2976 - protein, 13 aa, Artificial Sequence
  synthetic polypeptide
WVSGINYNSGYTS

SEQ ID NO: 2977 - protein, 13 aa, Artificial Sequence
  synthetic polypeptide
WVAGINYNGGYKG

SEQ ID NO: 2978 - protein, 13 aa, Artificial Sequence
  synthetic polypeptide
WVSNINYNSGYKS

SEQ ID NO: 2979 - protein, 13 aa, Artificial Sequence
  synthetic polypeptide
WVSNINYNSGYKS

SEQ ID NO: 2980 - protein, 13 aa, Artificial Sequence
  synthetic polypeptide
WVSNINYNSGYKS

SEQ ID NO: 2981 - protein, 13 aa, Artificial Sequence
  synthetic polypeptide
WVSGINYNGGYTS

SEQ ID NO: 2982 - protein, 13 aa, Artificial Sequence
  synthetic polypeptide
WVAGINYNGGYTS

SEQ ID NO: 2983 - protein, 13 aa, Artificial Sequence
  synthetic polypeptide
WVANINYNSGYKG

SEQ ID NO: 2984 - protein, 13 aa, Artificial Sequence
  synthetic polypeptide
WVANINYNGGYTG

SEQ ID NO: 2985 - protein, 13 aa, Artificial Sequence
  synthetic polypeptide
WVANINYNGGYTG

SEQ ID NO: 2986 - protein, 13 aa, Artificial Sequence
  synthetic polypeptide
WVANINYNGGYKS

SEQ ID NO: 2987 - protein, 13 aa, Artificial Sequence
  synthetic polypeptide
WVSGINYNGGYTS

SEQ ID NO: 2988 - protein, 13 aa, Artificial Sequence
  synthetic polypeptide
WVSGINYNSGYKS

SEQ ID NO: 2989 - protein, 13 aa, Artificial Sequence
  synthetic polypeptide
WVSNINYNGGYTS

SEQ ID NO: 2990 - protein, 13 aa, Artificial Sequence
  synthetic polypeptide
WVSGINYNGGYTS

SEQ ID NO: 2991 - protein, 13 aa, Artificial Sequence
  synthetic polypeptide
WVAGINYNGGYTS

SEQ ID NO: 2992 - protein, 13 aa, Artificial Sequence
  synthetic polypeptide
WVSGINYNSGYTG

SEQ ID NO: 2993 - protein, 13 aa, Artificial Sequence
  synthetic polypeptide
WVAGINYNGGYKG

SEQ ID NO: 2994 - protein, 13 aa, Artificial Sequence
  synthetic polypeptide
WVAGINYNSGYTG

SEQ ID NO: 2995 - protein, 13 aa, Artificial Sequence
  synthetic polypeptide
WVAGINYNGGYKG

SEQ ID NO: 2996 - protein, 13 aa, Artificial Sequence
  synthetic polypeptide
WVSGINYNGGYTS

SEQ ID NO: 2997 - protein, 13 aa, Artificial Sequence
  synthetic polypeptide
WVANINYNSGYKG

SEQ ID NO: 2998 - protein, 13 aa, Artificial Sequence
  synthetic polypeptide
WVSGINYNGGYTG

SEQ ID NO: 2999 - protein, 13 aa, Artificial Sequence
  synthetic polypeptide
WVSSINYNGGYKG

SEQ ID NO: 3000 - protein, 13 aa, Artificial Sequence
  synthetic polypeptide
WVSGINYNSGYKS

SEQ ID NO: 3001 - protein, 13 aa, Artificial Sequence
  synthetic polypeptide
WVSNINYNGGYTG

SEQ ID NO: 3002 - protein, 13 aa, Artificial Sequence
  synthetic polypeptide
WVSGINYNSGYTS

SEQ ID NO: 3003 - protein, 13 aa, Artificial Sequence
  synthetic polypeptide
WVSNINYNGGYKG

SEQ ID NO: 3004 - protein, 13 aa, Artificial Sequence
  synthetic polypeptide
WVAGINYNGGYTS

SEQ ID NO: 3005 - protein, 13 aa, Artificial Sequence
  synthetic polypeptide
WVANINYNGGYKG

SEQ ID NO: 3006 - protein, 13 aa, Artificial Sequence
  synthetic polypeptide
WVANINYNGGYTG

SEQ ID NO: 3007 - protein, 13 aa, Artificial Sequence
  synthetic polypeptide
WVSSINYNGGYTS

SEQ ID NO: 3008 - protein, 13 aa, Artificial Sequence
  synthetic polypeptide
WVAGINYNGGYKS

SEQ ID NO: 3009 - protein, 13 aa, Artificial Sequence
  synthetic polypeptide
WVSGINYNSGYTS

SEQ ID NO: 3010 - protein, 13 aa, Artificial Sequence
  synthetic polypeptide
WVASINYNSGYTS

SEQ ID NO: 3011 - protein, 13 aa, Artificial Sequence
  synthetic polypeptide
WVSGINYNSGYKG

SEQ ID NO: 3012 - protein, 13 aa, Artificial Sequence
  synthetic polypeptide
WVANINYNGGYTS

SEQ ID NO: 3013 - protein, 13 aa, Artificial Sequence
  synthetic polypeptide
WVANINYNGGYTG

SEQ ID NO: 3014 - protein, 13 aa, Artificial Sequence
  synthetic polypeptide
WVAGINYNGGYTS

SEQ ID NO: 3015 - protein, 13 aa, Artificial Sequence
  synthetic polypeptide
WVSNINYNGGYKS

SEQ ID NO: 3016 - protein, 13 aa, Artificial Sequence
  synthetic polypeptide
WVSSINYNGGYTS

SEQ ID NO: 3017 - protein, 13 aa, Artificial Sequence
  synthetic polypeptide
WVAGINYNSGYTS

SEQ ID NO: 3018 - protein, 13 aa, Artificial Sequence
  synthetic polypeptide
WVAGINYNGGYKS

SEQ ID NO: 3019 - protein, 13 aa, Artificial Sequence
  synthetic polypeptide
WVAGINYNGGYTS

SEQ ID NO: 3020 - protein, 13 aa, Artificial Sequence
  synthetic polypeptide
WVSNINYNGGYKG

SEQ ID NO: 3021 - protein, 13 aa, Artificial Sequence
  synthetic polypeptide
WVAGINYNGGYTS

SEQ ID NO: 3022 - protein, 13 aa, Artificial Sequence
  synthetic polypeptide
WVSNINYNSGYTG

SEQ ID NO: 3023 - protein, 13 aa, Artificial Sequence
  synthetic polypeptide
WVAGINYNGGYTG

SEQ ID NO: 3024 - protein, 13 aa, Artificial Sequence
  synthetic polypeptide
WVAGINYNSGYKG

SEQ ID NO: 3025 - protein, 13 aa, Artificial Sequence
  synthetic polypeptide
WVANINYNGGYTS

SEQ ID NO: 3026 - protein, 13 aa, Artificial Sequence
  synthetic polypeptide
WVSGINYNGGYTG

SEQ ID NO: 3027 - protein, 13 aa, Artificial Sequence
  synthetic polypeptide
WVSGINYNSGYTG

SEQ ID NO: 3028 - protein, 13 aa, Artificial Sequence
  synthetic polypeptide
WVSGINYNGGYKS

SEQ ID NO: 3029 - protein, 13 aa, Artificial Sequence
  synthetic polypeptide
WVSNINYNGGYTS

SEQ ID NO: 3030 - protein, 13 aa, Artificial Sequence
  synthetic polypeptide
WVSGINYNSGYTS

SEQ ID NO: 3031 - protein, 13 aa, Artificial Sequence
  synthetic polypeptide
WVANINYNGGYTS

SEQ ID NO: 3032 - protein, 13 aa, Artificial Sequence
  synthetic polypeptide
WVSNINYNSGYTS

SEQ ID NO: 3033 - protein, 13 aa, Artificial Sequence
  synthetic polypeptide
WVAGINYNGGYTG

SEQ ID NO: 3034 - protein, 13 aa, Artificial Sequence
  synthetic polypeptide
WVAGINYNGGYTS

SEQ ID NO: 3035 - protein, 13 aa, Artificial Sequence
  synthetic polypeptide
WVAGINYNGGYKS

SEQ ID NO: 3036 - protein, 13 aa, Artificial Sequence
  synthetic polypeptide
WVSNINYNSGYTG

SEQ ID NO: 3037 - protein, 13 aa, Artificial Sequence
  synthetic polypeptide
WVANINYNSGYKG

SEQ ID NO: 3038 - protein, 13 aa, Artificial Sequence
  synthetic polypeptide
WVSGINYNGGYKG

SEQ ID NO: 3039 - protein, 13 aa, Artificial Sequence
  synthetic polypeptide
WVSNINYNGGYTG

SEQ ID NO: 3040 - protein, 13 aa, Artificial Sequence
  synthetic polypeptide
WVSGINYNSGYTS

SEQ ID NO: 3041 - protein, 13 aa, Artificial Sequence
  synthetic polypeptide
WVAGINYNSGYKG

SEQ ID NO: 3042 - protein, 13 aa, Artificial Sequence
  synthetic polypeptide
WVAGINYNGGYTG

SEQ ID NO: 3043 - protein, 13 aa, Artificial Sequence
  synthetic polypeptide
WVSNINYNGGYTS

SEQ ID NO: 3044 - protein, 13 aa, Artificial Sequence
  synthetic polypeptide
WVSSINYNSGYTS

SEQ ID NO: 3045 - protein, 13 aa, Artificial Sequence
  synthetic polypeptide
WVSGINYNSGYKG

SEQ ID NO: 3046 - protein, 13 aa, Artificial Sequence
  synthetic polypeptide
WVANINYNSGYTG

SEQ ID NO: 3047 - protein, 13 aa, Artificial Sequence
  synthetic polypeptide
WVAGINYNGGYTG

SEQ ID NO: 3048 - protein, 13 aa, Artificial Sequence
  synthetic polypeptide
WVANINYNGGYTS

SEQ ID NO: 3049 - protein, 13 aa, Artificial Sequence
  synthetic polypeptide
WVSGINYNSGYTG

SEQ ID NO: 3050 - protein, 13 aa, Artificial Sequence
  synthetic polypeptide
WVSGINYNSGYKS

SEQ ID NO: 3051 - protein, 13 aa, Artificial Sequence
  synthetic polypeptide
WVSGINYNSGYKG

SEQ ID NO: 3052 - protein, 13 aa, Artificial Sequence
  synthetic polypeptide
WVSGINYNSGYKG

SEQ ID NO: 3053 - protein, 13 aa, Artificial Sequence
  synthetic polypeptide
WVSGINYNGGYKS

SEQ ID NO: 3054 - protein, 13 aa, Artificial Sequence
  synthetic polypeptide
WVSNINYNSGYKG

SEQ ID NO: 3055 - protein, 13 aa, Artificial Sequence
  synthetic polypeptide
WVSGINYNGGYKG

SEQ ID NO: 3056 - protein, 13 aa, Artificial Sequence
  synthetic polypeptide
WVSNINYNGGYTS

SEQ ID NO: 3057 - protein, 13 aa, Artificial Sequence
  synthetic polypeptide
WVANINYNGGYTS

SEQ ID NO: 3058 - protein, 13 aa, Artificial Sequence
  synthetic polypeptide
WVANINYNGGYTG

SEQ ID NO: 3059 - protein, 13 aa, Artificial Sequence
  synthetic polypeptide
WVSNINYNGGYKS

SEQ ID NO: 3060 - protein, 13 aa, Artificial Sequence
  synthetic polypeptide
WVSNINYNGGYTS

SEQ ID NO: 3061 - protein, 13 aa, Artificial Sequence
  synthetic polypeptide
WVANINYNGGYTG

SEQ ID NO: 3062 - protein, 13 aa, Artificial Sequence
  synthetic polypeptide
WVANINYNGGYKG

SEQ ID NO: 3063 - protein, 13 aa, Artificial Sequence
  synthetic polypeptide
WVSGINYNSGYKG

SEQ ID NO: 3064 - protein, 13 aa, Artificial Sequence
  synthetic polypeptide
WVSNINYNSGYTG

SEQ ID NO: 3065 - protein, 13 aa, Artificial Sequence
  synthetic polypeptide
WVAGINYNSGYKG

SEQ ID NO: 3066 - protein, 13 aa, Artificial Sequence
  synthetic polypeptide
WVAGINYNGGYTG

SEQ ID NO: 3067 - protein, 13 aa, Artificial Sequence
  synthetic polypeptide
WVSGINYNSGYTS

SEQ ID NO: 3068 - protein, 13 aa, Artificial Sequence
  synthetic polypeptide
WVSSINYNSGYKG

SEQ ID NO: 3069 - protein, 13 aa, Artificial Sequence
  synthetic polypeptide
WVSGINYNSGYKG

SEQ ID NO: 3070 - protein, 13 aa, Artificial Sequence
  synthetic polypeptide
WVSGINYNSGYTG

SEQ ID NO: 3071 - protein, 13 aa, Artificial Sequence
  synthetic polypeptide
WVAGINYNGGYTS

SEQ ID NO: 3072 - protein, 13 aa, Artificial Sequence
  synthetic polypeptide
WVSGINYNGGYTS

SEQ ID NO: 3073 - protein, 13 aa, Artificial Sequence
  synthetic polypeptide
WVAGINYNGGYTS

SEQ ID NO: 3074 - protein, 13 aa, Artificial Sequence
  synthetic polypeptide
WVAGINYNGGYTS

SEQ ID NO: 3075 - protein, 13 aa, Artificial Sequence
  synthetic polypeptide
WVAGINYNGGYKS

SEQ ID NO: 3076 - protein, 13 aa, Artificial Sequence
  synthetic polypeptide
WVSNINYNGGYTS

SEQ ID NO: 3077 - protein, 13 aa, Artificial Sequence
  synthetic polypeptide
WVSNINYNGGYTG

SEQ ID NO: 3078 - protein, 13 aa, Artificial Sequence
  synthetic polypeptide
WVANINYNSGYTS

SEQ ID NO: 3079 - protein, 13 aa, Artificial Sequence
  synthetic polypeptide
WVSGINYNSGYKS

SEQ ID NO: 3080 - protein, 13 aa, Artificial Sequence
  synthetic polypeptide
WVSGINYNGGYTS

SEQ ID NO: 3081 - protein, 13 aa, Artificial Sequence
  synthetic polypeptide
WVSNINYNGGYTG

SEQ ID NO: 3082 - protein, 13 aa, Artificial Sequence
  synthetic polypeptide
WVAGINYNGGYTG

SEQ ID NO: 3083 - protein, 13 aa, Artificial Sequence
  synthetic polypeptide
WVASINYNGGYTS

SEQ ID NO: 3084 - protein, 13 aa, Artificial Sequence
  synthetic polypeptide
WVSGINYNSGYKS

SEQ ID NO: 3085 - protein, 13 aa, Artificial Sequence
  synthetic polypeptide
WVSGINYNSGYKS

SEQ ID NO: 3086 - protein, 13 aa, Artificial Sequence
  synthetic polypeptide
WVSGINYNSGYTS

SEQ ID NO: 3087 - protein, 13 aa, Artificial Sequence
  synthetic polypeptide
WVSNINYNGGYTG

SEQ ID NO: 3088 - protein, 13 aa, Artificial Sequence
  synthetic polypeptide
WVANINYNGGYTG

SEQ ID NO: 3089 - protein, 13 aa, Artificial Sequence
  synthetic polypeptide
WVANINYNSGYKS

SEQ ID NO: 3090 - protein, 13 aa, Artificial Sequence
  synthetic polypeptide
WVANINYNGGYKG

SEQ ID NO: 3091 - protein, 13 aa, Artificial Sequence
  synthetic polypeptide
WVASINYNSGYTS

SEQ ID NO: 3092 - protein, 13 aa, Artificial Sequence
  synthetic polypeptide
WVSNINYNGGYTG

SEQ ID NO: 3093 - protein, 13 aa, Artificial Sequence
  synthetic polypeptide
WVASINYNSGYTS

SEQ ID NO: 3094 - protein, 13 aa, Artificial Sequence
  synthetic polypeptide
WVANINYNSGYTG

SEQ ID NO: 3095 - protein, 13 aa, Artificial Sequence
  synthetic polypeptide
WVSGINYNSGYKG

SEQ ID NO: 3096 - protein, 13 aa, Artificial Sequence
  synthetic polypeptide
WVSSINYNSGYTS

SEQ ID NO: 3097 - protein, 13 aa, Artificial Sequence
  synthetic polypeptide
WVSGINYNSGYKS

SEQ ID NO: 3098 - protein, 13 aa, Artificial Sequence
  synthetic polypeptide
WVAGINYNSGYKG

SEQ ID NO: 3099 - protein, 13 aa, Artificial Sequence
  synthetic polypeptide
WVAGINYNGGYKG

SEQ ID NO: 3100 - protein, 13 aa, Artificial Sequence
  synthetic polypeptide
WVSNINYNGGYTS

SEQ ID NO: 3101 - protein, 13 aa, Artificial Sequence
  synthetic polypeptide
WVSNINYNSGYKG

SEQ ID NO: 3102 - protein, 13 aa, Artificial Sequence
  synthetic polypeptide
WVANINYNSGYKG

SEQ ID NO: 3103 - protein, 13 aa, Artificial Sequence
  synthetic polypeptide
WVASINYNGGYTG

SEQ ID NO: 3104 - protein, 13 aa, Artificial Sequence
  synthetic polypeptide
WVANINYNGGYTG

SEQ ID NO: 3105 - protein, 13 aa, Artificial Sequence
  synthetic polypeptide
WVANINYNSGYKG

SEQ ID NO: 3106 - protein, 13 aa, Artificial Sequence
  synthetic polypeptide
WVSGINYNGGYTS

SEQ ID NO: 3107 - protein, 13 aa, Artificial Sequence
  synthetic polypeptide
WVAGINYNGGYTS

SEQ ID NO: 3108 - protein, 13 aa, Artificial Sequence
  synthetic polypeptide
WVSGINYNSGYTS

SEQ ID NO: 3109 - protein, 13 aa, Artificial Sequence
  synthetic polypeptide
WVAGINYNGGYTG

SEQ ID NO: 3110 - protein, 13 aa, Artificial Sequence
  synthetic polypeptide
WVSNINYNGGYKG

SEQ ID NO: 3111 - protein, 13 aa, Artificial Sequence
  synthetic polypeptide
WVANINYNGGYTG

SEQ ID NO: 3112 - protein, 13 aa, Artificial Sequence
  synthetic polypeptide
WVANINYNGGYTG

SEQ ID NO: 3113 - protein, 13 aa, Artificial Sequence
  synthetic polypeptide
WVAGINYNGGYTS

SEQ ID NO: 3114 - protein, 13 aa, Artificial Sequence
  synthetic polypeptide
WVANINYNGGYTG

SEQ ID NO: 3115 - protein, 13 aa, Artificial Sequence
  synthetic polypeptide
WVSNINYNSGYTG

SEQ ID NO: 3116 - protein, 13 aa, Artificial Sequence
  synthetic polypeptide
WVANINYNGGYTS

SEQ ID NO: 3117 - protein, 13 aa, Artificial Sequence
  synthetic polypeptide
WVSGINYNSGYKG

SEQ ID NO: 3118 - protein, 13 aa, Artificial Sequence
  synthetic polypeptide
WVANINYNGGYTG

SEQ ID NO: 3119 - protein, 13 aa, Artificial Sequence
  synthetic polypeptide
WVSGINYNSGYKS

SEQ ID NO: 3120 - protein, 12 aa, Artificial Sequence
  synthetic polypeptide
ARSANWHDTALD

SEQ ID NO: 3121 - protein, 12 aa, Artificial Sequence
  synthetic polypeptide
ARSANWHDTALD

SEQ ID NO: 3122 - protein, 12 aa, Artificial Sequence
  synthetic polypeptide
AKSANWHDTHLD

SEQ ID NO: 3123 - protein, 12 aa, Artificial Sequence
  synthetic polypeptide
ARSANWHDTALD

SEQ ID NO: 3124 - protein, 12 aa, Artificial Sequence
  synthetic polypeptide
ARSANWHDTALD

SEQ ID NO: 3125 - protein, 12 aa, Artificial Sequence
  synthetic polypeptide
ARSANWHDTALD

SEQ ID NO: 3126 - protein, 12 aa, Artificial Sequence
  synthetic polypeptide
ARSANWHDTALD

SEQ ID NO: 3127 - protein, 12 aa, Artificial Sequence
  synthetic polypeptide
ARSANWHDTHLD

SEQ ID NO: 3128 - protein, 12 aa, Artificial Sequence
  synthetic polypeptide
ARSANWHDTALD

SEQ ID NO: 3129 - protein, 12 aa, Artificial Sequence
  synthetic polypeptide
ARSANWHDTHLD

SEQ ID NO: 3130 - protein, 12 aa, Artificial Sequence
  synthetic polypeptide
ARSANWHDTALD

SEQ ID NO: 3131 - protein, 12 aa, Artificial Sequence
  synthetic polypeptide
ARSANWHDTALD

SEQ ID NO: 3132 - protein, 12 aa, Artificial Sequence
  synthetic polypeptide
ARSANWHDTALD

SEQ ID NO: 3133 - protein, 12 aa, Artificial Sequence
  synthetic polypeptide
ARSANWHDTALD

SEQ ID NO: 3134 - protein, 12 aa, Artificial Sequence
  synthetic polypeptide
ARSANWHDTALD

SEQ ID NO: 3135 - protein, 12 aa, Artificial Sequence
  synthetic polypeptide
ARSANWHDTALD

SEQ ID NO: 3136 - protein, 12 aa, Artificial Sequence
  synthetic polypeptide
AKSANWHDTHLD

SEQ ID NO: 3137 - protein, 12 aa, Artificial Sequence
  synthetic polypeptide
ARSANWHDTALD

SEQ ID NO: 3138 - protein, 12 aa, Artificial Sequence
  synthetic polypeptide
ARSANWHDTHLD

SEQ ID NO: 3139 - protein, 12 aa, Artificial Sequence
  synthetic polypeptide
ARSANWHDTALD

SEQ ID NO: 3140 - protein, 12 aa, Artificial Sequence
  synthetic polypeptide
ARSANWHDTHLD

SEQ ID NO: 3141 - protein, 12 aa, Artificial Sequence
  synthetic polypeptide
ARSANWHDTALD

SEQ ID NO: 3142 - protein, 12 aa, Artificial Sequence
  synthetic polypeptide
ARSANWHDTALD

SEQ ID NO: 3143 - protein, 12 aa, Artificial Sequence
  synthetic polypeptide
ARSANWHDTHLD

SEQ ID NO: 3144 - protein, 12 aa, Artificial Sequence
  synthetic polypeptide
ARSANWHDTALD

SEQ ID NO: 3145 - protein, 12 aa, Artificial Sequence
  synthetic polypeptide
ARSANWHDTALD

SEQ ID NO: 3146 - protein, 12 aa, Artificial Sequence
  synthetic polypeptide
ARSANWHDTHLD

SEQ ID NO: 3147 - protein, 12 aa, Artificial Sequence
  synthetic polypeptide
ARSANWHDTALD

SEQ ID NO: 3148 - protein, 12 aa, Artificial Sequence
  synthetic polypeptide
ARSANWHDTHLD

SEQ ID NO: 3149 - protein, 12 aa, Artificial Sequence
  synthetic polypeptide
ARSANWHDTALD

SEQ ID NO: 3150 - protein, 12 aa, Artificial Sequence
  synthetic polypeptide
ARSANWHDTHLD

SEQ ID NO: 3151 - protein, 12 aa, Artificial Sequence
  synthetic polypeptide
ARSANWHDTALD

SEQ ID NO: 3152 - protein, 12 aa, Artificial Sequence
  synthetic polypeptide
ARSANWHDTALD

SEQ ID NO: 3153 - protein, 12 aa, Artificial Sequence
  synthetic polypeptide
ARSANWHDTALD

SEQ ID NO: 3154 - protein, 12 aa, Artificial Sequence
  synthetic polypeptide
ARSANWHDTHLD

SEQ ID NO: 3155 - protein, 12 aa, Artificial Sequence
  synthetic polypeptide
ARSANWHDTALD

SEQ ID NO: 3156 - protein, 12 aa, Artificial Sequence
  synthetic polypeptide
ARSANWHDTHLD

SEQ ID NO: 3157 - protein, 12 aa, Artificial Sequence
  synthetic polypeptide
ARSANWHDTHLD

SEQ ID NO: 3158 - protein, 12 aa, Artificial Sequence
  synthetic polypeptide
ARSANWHDTALD

SEQ ID NO: 3159 - protein, 12 aa, Artificial Sequence
  synthetic polypeptide
ARSANWHDTALD

SEQ ID NO: 3160 - protein, 12 aa, Artificial Sequence
  synthetic polypeptide
ARSANWHDTALD

SEQ ID NO: 3161 - protein, 12 aa, Artificial Sequence
  synthetic polypeptide
ARSANWHDTALD

SEQ ID NO: 3162 - protein, 12 aa, Artificial Sequence
  synthetic polypeptide
ARSANWHDTHLD

SEQ ID NO: 3163 - protein, 12 aa, Artificial Sequence
  synthetic polypeptide
ARSANWHDTALD

SEQ ID NO: 3164 - protein, 12 aa, Artificial Sequence
  synthetic polypeptide
ARSANWHDTALD

SEQ ID NO: 3165 - protein, 12 aa, Artificial Sequence
  synthetic polypeptide
ARSANWHDTALD

SEQ ID NO: 3166 - protein, 12 aa, Artificial Sequence
  synthetic polypeptide
ARSANWHDTALD

SEQ ID NO: 3167 - protein, 12 aa, Artificial Sequence
  synthetic polypeptide
ARSANWHDTALD

SEQ ID NO: 3168 - protein, 12 aa, Artificial Sequence
  synthetic polypeptide
ARSANWHDTHLD

SEQ ID NO: 3169 - protein, 12 aa, Artificial Sequence
  synthetic polypeptide
ARSANWHDTALD

SEQ ID NO: 3170 - protein, 12 aa, Artificial Sequence
  synthetic polypeptide
ARSANWHDTHLD

SEQ ID NO: 3171 - protein, 12 aa, Artificial Sequence
  synthetic polypeptide
ARSANWHDTHLD

SEQ ID NO: 3172 - protein, 12 aa, Artificial Sequence
  synthetic polypeptide
ARSANWHDTHLD

SEQ ID NO: 3173 - protein, 12 aa, Artificial Sequence
  synthetic polypeptide
ARSANWHDTALD

SEQ ID NO: 3174 - protein, 12 aa, Artificial Sequence
  synthetic polypeptide
ARSANWHDTALD

SEQ ID NO: 3175 - protein, 12 aa, Artificial Sequence
  synthetic polypeptide
ARSANWHDTHLD

SEQ ID NO: 3176 - protein, 12 aa, Artificial Sequence
  synthetic polypeptide
ARSANWHDTHLD

SEQ ID NO: 3177 - protein, 12 aa, Artificial Sequence
  synthetic polypeptide
ARSANWHDTALD

SEQ ID NO: 3178 - protein, 12 aa, Artificial Sequence
  synthetic polypeptide
ARSANWHDTHLD

SEQ ID NO: 3179 - protein, 12 aa, Artificial Sequence
  synthetic polypeptide
ARSANWHDTALD

SEQ ID NO: 3180 - protein, 12 aa, Artificial Sequence
  synthetic polypeptide
ARSANWHDTALD

SEQ ID NO: 3181 - protein, 12 aa, Artificial Sequence
  synthetic polypeptide
ARSANWHDTHLD

SEQ ID NO: 3182 - protein, 12 aa, Artificial Sequence
  synthetic polypeptide
ARSANWHDTALD

SEQ ID NO: 3183 - protein, 12 aa, Artificial Sequence
  synthetic polypeptide
ARSANWHDTHLD

SEQ ID NO: 3184 - protein, 12 aa, Artificial Sequence
  synthetic polypeptide
ARSANWHDTALD

SEQ ID NO: 3185 - protein, 12 aa, Artificial Sequence
  synthetic polypeptide
ARSANWHDTHLD

SEQ ID NO: 3186 - protein, 12 aa, Artificial Sequence
  synthetic polypeptide
ARSANWHDTALD

SEQ ID NO: 3187 - protein, 12 aa, Artificial Sequence
  synthetic polypeptide
ARSANWHDTALD

SEQ ID NO: 3188 - protein, 12 aa, Artificial Sequence
  synthetic polypeptide
ARSANWHDTALD

SEQ ID NO: 3189 - protein, 12 aa, Artificial Sequence
  synthetic polypeptide
ARSANWHDTHLD

SEQ ID NO: 3190 - protein, 12 aa, Artificial Sequence
  synthetic polypeptide
ARSANWHDTHLD

SEQ ID NO: 3191 - protein, 12 aa, Artificial Sequence
  synthetic polypeptide
ARSANWHDTALD

SEQ ID NO: 3192 - protein, 12 aa, Artificial Sequence
  synthetic polypeptide
ARSANWHDTALD

SEQ ID NO: 3193 - protein, 12 aa, Artificial Sequence
  synthetic polypeptide
ARSANWHDTALD

SEQ ID NO: 3194 - protein, 12 aa, Artificial Sequence
  synthetic polypeptide
ARSANWHDTALD

SEQ ID NO: 3195 - protein, 12 aa, Artificial Sequence
  synthetic polypeptide
ARSANWHDTALD

SEQ ID NO: 3196 - protein, 12 aa, Artificial Sequence
  synthetic polypeptide
ARSANWHDTALD

SEQ ID NO: 3197 - protein, 12 aa, Artificial Sequence
  synthetic polypeptide
ARSANWHDTALD

SEQ ID NO: 3198 - protein, 12 aa, Artificial Sequence
  synthetic polypeptide
ARSANWHDTALD

SEQ ID NO: 3199 - protein, 12 aa, Artificial Sequence
  synthetic polypeptide
ARSANWHDTHLD

SEQ ID NO: 3200 - protein, 12 aa, Artificial Sequence
  synthetic polypeptide
ARSANWHDTHLD

SEQ ID NO: 3201 - protein, 12 aa, Artificial Sequence
  synthetic polypeptide
ARSANWHDTALD

SEQ ID NO: 3202 - protein, 12 aa, Artificial Sequence
  synthetic polypeptide
ARSANWHDTALD

SEQ ID NO: 3203 - protein, 12 aa, Artificial Sequence
  synthetic polypeptide
AKSANWHDTALD

SEQ ID NO: 3204 - protein, 12 aa, Artificial Sequence
  synthetic polypeptide
AKSANWHDTALD

SEQ ID NO: 3205 - protein, 12 aa, Artificial Sequence
  synthetic polypeptide
ARSANWHDTHLD

SEQ ID NO: 3206 - protein, 12 aa, Artificial Sequence
  synthetic polypeptide
ARSANWHDTALD

SEQ ID NO: 3207 - protein, 12 aa, Artificial Sequence
  synthetic polypeptide
ARSANWHDTALD

SEQ ID NO: 3208 - protein, 12 aa, Artificial Sequence
  synthetic polypeptide
AKSANWHDTHLD

SEQ ID NO: 3209 - protein, 12 aa, Artificial Sequence
  synthetic polypeptide
ARSANWHDTHLD

SEQ ID NO: 3210 - protein, 12 aa, Artificial Sequence
  synthetic polypeptide
ARSANWHDTALD

SEQ ID NO: 3211 - protein, 12 aa, Artificial Sequence
  synthetic polypeptide
ARSANWHDTALD

SEQ ID NO: 3212 - protein, 12 aa, Artificial Sequence
  synthetic polypeptide
ARSANWHDTALD

SEQ ID NO: 3213 - protein, 12 aa, Artificial Sequence
  synthetic polypeptide
ARSANWHDTALD

SEQ ID NO: 3214 - protein, 12 aa, Artificial Sequence
  synthetic polypeptide
ARSANWHDTALD

SEQ ID NO: 3215 - protein, 12 aa, Artificial Sequence
  synthetic polypeptide
ARSANWHDTALD

SEQ ID NO: 3216 - protein, 12 aa, Artificial Sequence
  synthetic polypeptide
ARSANWHDTALD

SEQ ID NO: 3217 - protein, 12 aa, Artificial Sequence
  synthetic polypeptide
ARSANWHDTALD

SEQ ID NO: 3218 - protein, 12 aa, Artificial Sequence
  synthetic polypeptide
ARSANWHDTALD

SEQ ID NO: 3219 - protein, 12 aa, Artificial Sequence
  synthetic polypeptide
ARSANWHDTALD

SEQ ID NO: 3220 - protein, 12 aa, Artificial Sequence
  synthetic polypeptide
ARSANWHDTALD

SEQ ID NO: 3221 - protein, 12 aa, Artificial Sequence
  synthetic polypeptide
ARSANWHDTALD

SEQ ID NO: 3222 - protein, 12 aa, Artificial Sequence
  synthetic polypeptide
ARSANWHDTALD

SEQ ID NO: 3223 - protein, 12 aa, Artificial Sequence
  synthetic polypeptide
ARSANWHDTALD

SEQ ID NO: 3224 - protein, 12 aa, Artificial Sequence
  synthetic polypeptide
ARSANWHDTALD

SEQ ID NO: 3225 - protein, 12 aa, Artificial Sequence
  synthetic polypeptide
ARSANWHDTALD

SEQ ID NO: 3226 - protein, 12 aa, Artificial Sequence
  synthetic polypeptide
ARSANWHDTALD

SEQ ID NO: 3227 - protein, 12 aa, Artificial Sequence
  synthetic polypeptide
ARSANWHDTALD

SEQ ID NO: 3228 - protein, 12 aa, Artificial Sequence
  synthetic polypeptide
ARSANWHDTALD

SEQ ID NO: 3229 - protein, 12 aa, Artificial Sequence
  synthetic polypeptide
ARSANWHDTALD

SEQ ID NO: 3230 - protein, 12 aa, Artificial Sequence
  synthetic polypeptide
ARSANWHDTALD

SEQ ID NO: 3231 - protein, 12 aa, Artificial Sequence
  synthetic polypeptide
ARSANWHDTALD

SEQ ID NO: 3232 - protein, 12 aa, Artificial Sequence
  synthetic polypeptide
ARSANWHDTALD

SEQ ID NO: 3233 - protein, 12 aa, Artificial Sequence
  synthetic polypeptide
ARSANWHDTALD

SEQ ID NO: 3234 - protein, 12 aa, Artificial Sequence
  synthetic polypeptide
ARSANWHDTALD

SEQ ID NO: 3235 - protein, 12 aa, Artificial Sequence
  synthetic polypeptide
ARSANWHDTALD

SEQ ID NO: 3236 - protein, 12 aa, Artificial Sequence
  synthetic polypeptide
ARSANWHDTALD

SEQ ID NO: 3237 - protein, 12 aa, Artificial Sequence
  synthetic polypeptide
ARSANWHDTALD

SEQ ID NO: 3238 - protein, 12 aa, Artificial Sequence
  synthetic polypeptide
ARSANWHDTALD

SEQ ID NO: 3239 - protein, 12 aa, Artificial Sequence
  synthetic polypeptide
ARSANWHDTALD

SEQ ID NO: 3240 - protein, 12 aa, Artificial Sequence
  synthetic polypeptide
ARSANWHDTALD

SEQ ID NO: 3241 - protein, 12 aa, Artificial Sequence
  synthetic polypeptide
ARSANWHDTALD

SEQ ID NO: 3242 - protein, 12 aa, Artificial Sequence
  synthetic polypeptide
ARSANWHDTALD

SEQ ID NO: 3243 - protein, 12 aa, Artificial Sequence
  synthetic polypeptide
ARSANWHDTALD

SEQ ID NO: 3244 - protein, 12 aa, Artificial Sequence
  synthetic polypeptide
ARSANWHDTALD

SEQ ID NO: 3245 - protein, 12 aa, Artificial Sequence
  synthetic polypeptide
ARSANWHDTALD

SEQ ID NO: 3246 - protein, 12 aa, Artificial Sequence
  synthetic polypeptide
ARSANWHDTALD

SEQ ID NO: 3247 - protein, 12 aa, Artificial Sequence
  synthetic polypeptide
ARSANWHDTALD

SEQ ID NO: 3248 - protein, 12 aa, Artificial Sequence
  synthetic polypeptide
ARSANWHDTALD

SEQ ID NO: 3249 - protein, 12 aa, Artificial Sequence
  synthetic polypeptide
AKSANWHDTALD

SEQ ID NO: 3250 - protein, 12 aa, Artificial Sequence
  synthetic polypeptide
ARSANWHDTALD

SEQ ID NO: 3251 - protein, 12 aa, Artificial Sequence
  synthetic polypeptide
ARSANWHDTALD

SEQ ID NO: 3252 - protein, 12 aa, Artificial Sequence
  synthetic polypeptide
ARSANWHDTALD

SEQ ID NO: 3253 - protein, 12 aa, Artificial Sequence
  synthetic polypeptide
ARSANWHDTALD

SEQ ID NO: 3254 - protein, 12 aa, Artificial Sequence
  synthetic polypeptide
ARSANWHDTALD

SEQ ID NO: 3255 - protein, 12 aa, Artificial Sequence
  synthetic polypeptide
ARSANWHDTALD

SEQ ID NO: 3256 - protein, 12 aa, Artificial Sequence
  synthetic polypeptide
ARSANWHDTALD

SEQ ID NO: 3257 - protein, 12 aa, Artificial Sequence
  synthetic polypeptide
ARSANWHDTALD

SEQ ID NO: 3258 - protein, 12 aa, Artificial Sequence
  synthetic polypeptide
ARSANWHDTHLD

SEQ ID NO: 3259 - protein, 12 aa, Artificial Sequence
  synthetic polypeptide
ARSANWHDTALD

SEQ ID NO: 3260 - protein, 12 aa, Artificial Sequence
  synthetic polypeptide
ARSANWHDTALD

SEQ ID NO: 3261 - protein, 12 aa, Artificial Sequence
  synthetic polypeptide
ARSANWHDTALD

SEQ ID NO: 3262 - protein, 12 aa, Artificial Sequence
  synthetic polypeptide
ARSANWHDTALD

SEQ ID NO: 3263 - protein, 12 aa, Artificial Sequence
  synthetic polypeptide
ARSANWHDTALD

SEQ ID NO: 3264 - protein, 12 aa, Artificial Sequence
  synthetic polypeptide
ARSANWHDTALD

SEQ ID NO: 3265 - protein, 12 aa, Artificial Sequence
  synthetic polypeptide
ARSANWHDTALD

SEQ ID NO: 3266 - protein, 12 aa, Artificial Sequence
  synthetic polypeptide
ARSANWHDTALD

SEQ ID NO: 3267 - protein, 12 aa, Artificial Sequence
  synthetic polypeptide
ARSANWHDTALD

SEQ ID NO: 3268 - protein, 12 aa, Artificial Sequence
  synthetic polypeptide
ARSANWHDTALD

SEQ ID NO: 3269 - protein, 12 aa, Artificial Sequence
  synthetic polypeptide
ARSANWHDTALD

SEQ ID NO: 3270 - protein, 12 aa, Artificial Sequence
  synthetic polypeptide
ARSANWHDTALD

SEQ ID NO: 3271 - protein, 12 aa, Artificial Sequence
  synthetic polypeptide
ARSANWHDTALD

SEQ ID NO: 3272 - protein, 12 aa, Artificial Sequence
  synthetic polypeptide
ARSANWHDTALD

SEQ ID NO: 3273 - protein, 12 aa, Artificial Sequence
  synthetic polypeptide
ARSANWHDTALD

SEQ ID NO: 3274 - protein, 12 aa, Artificial Sequence
  synthetic polypeptide
ARSANWHDTALD

SEQ ID NO: 3275 - protein, 12 aa, Artificial Sequence
  synthetic polypeptide
ARSANWHDTALD

SEQ ID NO: 3276 - protein, 12 aa, Artificial Sequence
  synthetic polypeptide
ARSANWHDTALD

SEQ ID NO: 3277 - protein, 12 aa, Artificial Sequence
  synthetic polypeptide
ARSANWHDTALD

SEQ ID NO: 3278 - protein, 12 aa, Artificial Sequence
  synthetic polypeptide
ARSANWHDTALD

SEQ ID NO: 3279 - protein, 12 aa, Artificial Sequence
  synthetic polypeptide
ARSANWHDTALD

SEQ ID NO: 3280 - protein, 12 aa, Artificial Sequence
  synthetic polypeptide
ARSANWHDTHLD

SEQ ID NO: 3281 - protein, 12 aa, Artificial Sequence
  synthetic polypeptide
ARSANWHDTALD

SEQ ID NO: 3282 - protein, 12 aa, Artificial Sequence
  synthetic polypeptide
ARSANWHDTALD

SEQ ID NO: 3283 - protein, 12 aa, Artificial Sequence
  synthetic polypeptide
ARSANWHDTALD

SEQ ID NO: 3284 - protein, 12 aa, Artificial Sequence
  synthetic polypeptide
ARSANWHDTALD

SEQ ID NO: 3285 - protein, 12 aa, Artificial Sequence
  synthetic polypeptide
ARSANWHDTALD

SEQ ID NO: 3286 - protein, 12 aa, Artificial Sequence
  synthetic polypeptide
ARSANWHDTALD

SEQ ID NO: 3287 - protein, 12 aa, Artificial Sequence
  synthetic polypeptide
ARSANWHDTALD

SEQ ID NO: 3288 - protein, 12 aa, Artificial Sequence
  synthetic polypeptide
ARSANWHDTALD

SEQ ID NO: 3289 - protein, 12 aa, Artificial Sequence
  synthetic polypeptide
ARSANWHDTALD

SEQ ID NO: 3290 - protein, 12 aa, Artificial Sequence
  synthetic polypeptide
ARSANWHDTALD

SEQ ID NO: 3291 - protein, 12 aa, Artificial Sequence
  synthetic polypeptide
ARSANWHDTALD

SEQ ID NO: 3292 - protein, 12 aa, Artificial Sequence
  synthetic polypeptide
ARSANWHDTALD

SEQ ID NO: 3293 - protein, 12 aa, Artificial Sequence
  synthetic polypeptide
ARSANWHDTALD

SEQ ID NO: 3294 - protein, 12 aa, Artificial Sequence
  synthetic polypeptide
ARSANWHDTALD

SEQ ID NO: 3295 - protein, 12 aa, Artificial Sequence
  synthetic polypeptide
ARSANWHDTALD

SEQ ID NO: 3296 - protein, 12 aa, Artificial Sequence
  synthetic polypeptide
ARSANWHDTALD

SEQ ID NO: 3297 - protein, 12 aa, Artificial Sequence
  synthetic polypeptide
ARSANWHDTALD

SEQ ID NO: 3298 - protein, 12 aa, Artificial Sequence
  synthetic polypeptide
ARSANWHDTHLD

SEQ ID NO: 3299 - protein, 12 aa, Artificial Sequence
  synthetic polypeptide
ARSANWHDTALD

SEQ ID NO: 3300 - protein, 12 aa, Artificial Sequence
  synthetic polypeptide
ARSANWHDTALD

SEQ ID NO: 3301 - protein, 12 aa, Artificial Sequence
  synthetic polypeptide
ARSANWHDTALD

SEQ ID NO: 3302 - protein, 12 aa, Artificial Sequence
  synthetic polypeptide
ARSANWHDTALD

SEQ ID NO: 3303 - protein, 12 aa, Artificial Sequence
  synthetic polypeptide
ARSANWHDTALD

SEQ ID NO: 3304 - protein, 12 aa, Artificial Sequence
  synthetic polypeptide
ARSANWHDTALD

SEQ ID NO: 3305 - protein, 12 aa, Artificial Sequence
  synthetic polypeptide
ARSANWHDTALD

SEQ ID NO: 3306 - protein, 12 aa, Artificial Sequence
  synthetic polypeptide
ARSANWHDTALD

SEQ ID NO: 3307 - protein, 12 aa, Artificial Sequence
  synthetic polypeptide
ARSANWHDTALD

SEQ ID NO: 3308 - protein, 12 aa, Artificial Sequence
  synthetic polypeptide
ARSANWHDTALD

SEQ ID NO: 3309 - protein, 12 aa, Artificial Sequence
  synthetic polypeptide
ARSANWHDTALD

SEQ ID NO: 3310 - protein, 12 aa, Artificial Sequence
  synthetic polypeptide
ARSANWHDTALD

SEQ ID NO: 3311 - protein, 12 aa, Artificial Sequence
  synthetic polypeptide
ARSANWHDTALD

SEQ ID NO: 3312 - protein, 12 aa, Artificial Sequence
  synthetic polypeptide
ARSANWHDTALD

SEQ ID NO: 3313 - protein, 12 aa, Artificial Sequence
  synthetic polypeptide
ARSANWHDTHLD

SEQ ID NO: 3314 - protein, 12 aa, Artificial Sequence
  synthetic polypeptide
ARSANWHDTHLD

SEQ ID NO: 3315 - protein, 12 aa, Artificial Sequence
  synthetic polypeptide
ARSANWHDTALD

SEQ ID NO: 3316 - protein, 12 aa, Artificial Sequence
  synthetic polypeptide
ARSANWHDTALD

SEQ ID NO: 3317 - protein, 12 aa, Artificial Sequence
  synthetic polypeptide
ARSANWHDTALD

SEQ ID NO: 3318 - protein, 12 aa, Artificial Sequence
  synthetic polypeptide
ARSANWHDTHLD

SEQ ID NO: 3319 - protein, 12 aa, Artificial Sequence
  synthetic polypeptide
ARSANWHDTALD

SEQ ID NO: 3320 - protein, 12 aa, Artificial Sequence
  synthetic polypeptide
ARSANWHDTALD

SEQ ID NO: 3321 - protein, 12 aa, Artificial Sequence
  synthetic polypeptide
ARSANWHDTALD

SEQ ID NO: 3322 - protein, 12 aa, Artificial Sequence
  synthetic polypeptide
ARSANWHDTALD

SEQ ID NO: 3323 - protein, 12 aa, Artificial Sequence
  synthetic polypeptide
ARSANWHDTALD

SEQ ID NO: 3324 - protein, 12 aa, Artificial Sequence
  synthetic polypeptide
ARSANWHDTALD

SEQ ID NO: 3325 - protein, 12 aa, Artificial Sequence
  synthetic polypeptide
ARSANWHDTALD

SEQ ID NO: 3326 - protein, 12 aa, Artificial Sequence
  synthetic polypeptide
ARSANWHDTALD

SEQ ID NO: 3327 - protein, 12 aa, Artificial Sequence
  synthetic polypeptide
ARSANWHDTALD

SEQ ID NO: 3328 - protein, 12 aa, Artificial Sequence
  synthetic polypeptide
ARSANWHDTALD

SEQ ID NO: 3329 - protein, 12 aa, Artificial Sequence
  synthetic polypeptide
ARSANWHDTALD

SEQ ID NO: 3330 - protein, 12 aa, Artificial Sequence
  synthetic polypeptide
ARSANWHDTALD

SEQ ID NO: 3331 - protein, 12 aa, Artificial Sequence
  synthetic polypeptide
ARSANWHDTALD

SEQ ID NO: 3332 - protein, 12 aa, Artificial Sequence
  synthetic polypeptide
ARSANWHDTALD

SEQ ID NO: 3333 - protein, 12 aa, Artificial Sequence
  synthetic polypeptide
ARSANWHDTALD

SEQ ID NO: 3334 - protein, 12 aa, Artificial Sequence
  synthetic polypeptide
ARSANWHDTALD

SEQ ID NO: 3335 - protein, 12 aa, Artificial Sequence
  synthetic polypeptide
ARSANWHDTALD

SEQ ID NO: 3336 - protein, 12 aa, Artificial Sequence
  synthetic polypeptide
ARSANWHDTALD

SEQ ID NO: 3337 - protein, 12 aa, Artificial Sequence
  synthetic polypeptide
ARSANWHDTALD

SEQ ID NO: 3338 - protein, 12 aa, Artificial Sequence
  synthetic polypeptide
ARSANWHDTALD

SEQ ID NO: 3339 - protein, 12 aa, Artificial Sequence
  synthetic polypeptide
ARSANWHDTALD

SEQ ID NO: 3340 - protein, 12 aa, Artificial Sequence
  synthetic polypeptide
AKSANWHDTALD

SEQ ID NO: 3341 - protein, 12 aa, Artificial Sequence
  synthetic polypeptide
ARSANWHDTHLD

SEQ ID NO: 3342 - protein, 12 aa, Artificial Sequence
  synthetic polypeptide
ARSANWHDTALD

SEQ ID NO: 3343 - protein, 12 aa, Artificial Sequence
  synthetic polypeptide
ARSANWHDTALD

SEQ ID NO: 3344 - protein, 12 aa, Artificial Sequence
  synthetic polypeptide
ARSANWHDTALD

SEQ ID NO: 3345 - protein, 12 aa, Artificial Sequence
  synthetic polypeptide
ARSANWHDTALD

SEQ ID NO: 3346 - protein, 12 aa, Artificial Sequence
  synthetic polypeptide
ARSANWHDTALD

SEQ ID NO: 3347 - protein, 12 aa, Artificial Sequence
  synthetic polypeptide
ARSANWHDTALD

SEQ ID NO: 3348 - protein, 12 aa, Artificial Sequence
  synthetic polypeptide
ARSANWHDTALD

SEQ ID NO: 3349 - protein, 12 aa, Artificial Sequence
  synthetic polypeptide
ARSANWHDTALD

SEQ ID NO: 3350 - protein, 12 aa, Artificial Sequence
  synthetic polypeptide
ARSANWHDTALD

SEQ ID NO: 3351 - protein, 12 aa, Artificial Sequence
  synthetic polypeptide
ARSANWHDTALD

SEQ ID NO: 3352 - protein, 12 aa, Artificial Sequence
  synthetic polypeptide
ARSANWHDTALD

SEQ ID NO: 3353 - protein, 12 aa, Artificial Sequence
  synthetic polypeptide
ARSANWHDTALD

SEQ ID NO: 3354 - protein, 12 aa, Artificial Sequence
  synthetic polypeptide
ARSANWHDTALD

SEQ ID NO: 3355 - protein, 12 aa, Artificial Sequence
  synthetic polypeptide
ARSANWHDTALD

SEQ ID NO: 3356 - protein, 12 aa, Artificial Sequence
  synthetic polypeptide
ARSANWHDTALD

SEQ ID NO: 3357 - protein, 12 aa, Artificial Sequence
  synthetic polypeptide
ARSANWHDTALD

SEQ ID NO: 3358 - protein, 12 aa, Artificial Sequence
  synthetic polypeptide
ARSANWHDTALD

SEQ ID NO: 3359 - protein, 12 aa, Artificial Sequence
  synthetic polypeptide
ARSANWHDTALD

SEQ ID NO: 3360 - protein, 12 aa, Artificial Sequence
  synthetic polypeptide
ARSANWHDTALD

SEQ ID NO: 3361 - protein, 12 aa, Artificial Sequence
  synthetic polypeptide
ARSANWHDTALD

SEQ ID NO: 3362 - protein, 12 aa, Artificial Sequence
  synthetic polypeptide
ARSANWHDTALD

SEQ ID NO: 3363 - protein, 12 aa, Artificial Sequence
  synthetic polypeptide
ARSANWHDTALD

SEQ ID NO: 3364 - protein, 12 aa, Artificial Sequence
  synthetic polypeptide
ARSANWHDTALD

SEQ ID NO: 3365 - protein, 12 aa, Artificial Sequence
  synthetic polypeptide
ARSANWHDTALD

SEQ ID NO: 3366 - protein, 12 aa, Artificial Sequence
  synthetic polypeptide
ARSANWHDTALD

SEQ ID NO: 3367 - protein, 12 aa, Artificial Sequence
  synthetic polypeptide
ARSANWHDTALD

SEQ ID NO: 3368 - protein, 7 aa, Artificial Sequence
  synthetic polypeptide
LSYLNWY

SEQ ID NO: 3369 - protein, 7 aa, Artificial Sequence
  synthetic polypeptide
LSYLNWY

SEQ ID NO: 3370 - protein, 7 aa, Artificial Sequence
  synthetic polypeptide
LTYVNWY

SEQ ID NO: 3371 - protein, 7 aa, Artificial Sequence
  synthetic polypeptide
SSYVNWY

SEQ ID NO: 3372 - protein, 7 aa, Artificial Sequence
  synthetic polypeptide
LTYVNWY

SEQ ID NO: 3373 - protein, 7 aa, Artificial Sequence
  synthetic polypeptide
LTYLNWY

SEQ ID NO: 3374 - protein, 7 aa, Artificial Sequence
  synthetic polypeptide
ISYLNWY

SEQ ID NO: 3375 - protein, 7 aa, Artificial Sequence
  synthetic polypeptide
VSYLNWY

SEQ ID NO: 3376 - protein, 7 aa, Artificial Sequence
  synthetic polypeptide
LSYVNWY

SEQ ID NO: 3377 - protein, 7 aa, Artificial Sequence
  synthetic polypeptide
ITYLNWY

SEQ ID NO: 3378 - protein, 7 aa, Artificial Sequence
  synthetic polypeptide
VSYVNWY

SEQ ID NO: 3379 - protein, 7 aa, Artificial Sequence
  synthetic polypeptide
LSYLNWY

SEQ ID NO: 3380 - protein, 7 aa, Artificial Sequence
  synthetic polypeptide
VSYLNWY

SEQ ID NO: 3381 - protein, 7 aa, Artificial Sequence
  synthetic polypeptide
VTYLNWY

SEQ ID NO: 3382 - protein, 7 aa, Artificial Sequence
  synthetic polypeptide
ISYLNWY

SEQ ID NO: 3383 - protein, 7 aa, Artificial Sequence
  synthetic polypeptide
VSYVNWY

SEQ ID NO: 3384 - protein, 7 aa, Artificial Sequence
  synthetic polypeptide
LSYLNWY

SEQ ID NO: 3385 - protein, 7 aa, Artificial Sequence
  synthetic polypeptide
LTYVNWY

SEQ ID NO: 3386 - protein, 7 aa, Artificial Sequence
  synthetic polypeptide
VSYLNWY

SEQ ID NO: 3387 - protein, 7 aa, Artificial Sequence
  synthetic polypeptide
LSYVNWY

SEQ ID NO: 3388 - protein, 7 aa, Artificial Sequence
  synthetic polypeptide
LTYVNWY

SEQ ID NO: 3389 - protein, 7 aa, Artificial Sequence
  synthetic polypeptide
LTYVNWY

SEQ ID NO: 3390 - protein, 7 aa, Artificial Sequence
  synthetic polypeptide
ITYVNWY

SEQ ID NO: 3391 - protein, 7 aa, Artificial Sequence
  synthetic polypeptide
LTYLNWY

SEQ ID NO: 3392 - protein, 7 aa, Artificial Sequence
  synthetic polypeptide
LSYVNWY

SEQ ID NO: 3393 - protein, 7 aa, Artificial Sequence
  synthetic polypeptide
SSYVNWY

SEQ ID NO: 3394 - protein, 7 aa, Artificial Sequence
  synthetic polypeptide
VTYVNWY

SEQ ID NO: 3395 - protein, 7 aa, Artificial Sequence
  synthetic polypeptide
LTYLNWY

SEQ ID NO: 3396 - protein, 7 aa, Artificial Sequence
  synthetic polypeptide
ITYVNWY

SEQ ID NO: 3397 - protein, 7 aa, Artificial Sequence
  synthetic polypeptide
VSYVNWY

SEQ ID NO: 3398 - protein, 7 aa, Artificial Sequence
  synthetic polypeptide
VSYLNWY

SEQ ID NO: 3399 - protein, 7 aa, Artificial Sequence
  synthetic polypeptide
ISYLNWY

SEQ ID NO: 3400 - protein, 7 aa, Artificial Sequence
  synthetic polypeptide
LTYVNWY

SEQ ID NO: 3401 - protein, 7 aa, Artificial Sequence
  synthetic polypeptide
SSYVNWY

SEQ ID NO: 3402 - protein, 7 aa, Artificial Sequence
  synthetic polypeptide
LSYVNWY

SEQ ID NO: 3403 - protein, 7 aa, Artificial Sequence
  synthetic polypeptide
LSYVNWY

SEQ ID NO: 3404 - protein, 7 aa, Artificial Sequence
  synthetic polypeptide
LTYLNWY

SEQ ID NO: 3405 - protein, 7 aa, Artificial Sequence
  synthetic polypeptide
ITYLNWY

SEQ ID NO: 3406 - protein, 7 aa, Artificial Sequence
  synthetic polypeptide
ITYLNWY

SEQ ID NO: 3407 - protein, 7 aa, Artificial Sequence
  synthetic polypeptide
ISYVNWY

SEQ ID NO: 3408 - protein, 7 aa, Artificial Sequence
  synthetic polypeptide
LSYLNWY

SEQ ID NO: 3409 - protein, 7 aa, Artificial Sequence
  synthetic polypeptide
ISYVNWY

SEQ ID NO: 3410 - protein, 7 aa, Artificial Sequence
  synthetic polypeptide
LSYVNWY

SEQ ID NO: 3411 - protein, 7 aa, Artificial Sequence
  synthetic polypeptide
VSYVNWY

SEQ ID NO: 3412 - protein, 7 aa, Artificial Sequence
  synthetic polypeptide
ITYLNWY

SEQ ID NO: 3413 - protein, 7 aa, Artificial Sequence
  synthetic polypeptide
LSYLNWY

SEQ ID NO: 3414 - protein, 7 aa, Artificial Sequence
  synthetic polypeptide
VTYLNWY

SEQ ID NO: 3415 - protein, 7 aa, Artificial Sequence
  synthetic polypeptide
LTYLNWY

SEQ ID NO: 3416 - protein, 7 aa, Artificial Sequence
  synthetic polypeptide
ISYVNWY

SEQ ID NO: 3417 - protein, 7 aa, Artificial Sequence
  synthetic polypeptide
LTYLNWY

SEQ ID NO: 3418 - protein, 7 aa, Artificial Sequence
  synthetic polypeptide
LTYLNWY

SEQ ID NO: 3419 - protein, 7 aa, Artificial Sequence
  synthetic polypeptide
LSYVNWY

SEQ ID NO: 3420 - protein, 7 aa, Artificial Sequence
  synthetic polypeptide
LSYLNWY

SEQ ID NO: 3421 - protein, 7 aa, Artificial Sequence
  synthetic polypeptide
ISYLNWY

SEQ ID NO: 3422 - protein, 7 aa, Artificial Sequence
  synthetic polypeptide
LSYVNWY

SEQ ID NO: 3423 - protein, 7 aa, Artificial Sequence
  synthetic polypeptide
LSYLNWY

SEQ ID NO: 3424 - protein, 7 aa, Artificial Sequence
  synthetic polypeptide
SSYLNWY

SEQ ID NO: 3425 - protein, 7 aa, Artificial Sequence
  synthetic polypeptide
LSYLNWY

SEQ ID NO: 3426 - protein, 7 aa, Artificial Sequence
  synthetic polypeptide
VSYVNWY

SEQ ID NO: 3427 - protein, 7 aa, Artificial Sequence
  synthetic polypeptide
LSYVNWY

SEQ ID NO: 3428 - protein, 7 aa, Artificial Sequence
  synthetic polypeptide
ISYVNWY

SEQ ID NO: 3429 - protein, 7 aa, Artificial Sequence
  synthetic polypeptide
SSYLNWY

SEQ ID NO: 3430 - protein, 7 aa, Artificial Sequence
  synthetic polypeptide
VSYLNWY

SEQ ID NO: 3431 - protein, 7 aa, Artificial Sequence
  synthetic polypeptide
LTYVNWY

SEQ ID NO: 3432 - protein, 7 aa, Artificial Sequence
  synthetic polypeptide
ISYVNWY

SEQ ID NO: 3433 - protein, 7 aa, Artificial Sequence
  synthetic polypeptide
ITYLNWY

SEQ ID NO: 3434 - protein, 7 aa, Artificial Sequence
  synthetic polypeptide
ISYVNWY

SEQ ID NO: 3435 - protein, 7 aa, Artificial Sequence
  synthetic polypeptide
ISYLNWY

SEQ ID NO: 3436 - protein, 7 aa, Artificial Sequence
  synthetic polypeptide
VSYLNWY

SEQ ID NO: 3437 - protein, 7 aa, Artificial Sequence
  synthetic polypeptide
LTYLNWY

SEQ ID NO: 3438 - protein, 7 aa, Artificial Sequence
  synthetic polypeptide
LSYVNWY

SEQ ID NO: 3439 - protein, 7 aa, Artificial Sequence
  synthetic polypeptide
SSYLNWY

SEQ ID NO: 3440 - protein, 7 aa, Artificial Sequence
  synthetic polypeptide
ISYLNWY

SEQ ID NO: 3441 - protein, 7 aa, Artificial Sequence
  synthetic polypeptide
VSYLNWY

SEQ ID NO: 3442 - protein, 7 aa, Artificial Sequence
  synthetic polypeptide
LSYLNWY

SEQ ID NO: 3443 - protein, 7 aa, Artificial Sequence
  synthetic polypeptide
LSYLNWY

SEQ ID NO: 3444 - protein, 7 aa, Artificial Sequence
  synthetic polypeptide
STYVNWY

SEQ ID NO: 3445 - protein, 7 aa, Artificial Sequence
  synthetic polypeptide
LTYLNWY

SEQ ID NO: 3446 - protein, 7 aa, Artificial Sequence
  synthetic polypeptide
LTYLNWY

SEQ ID NO: 3447 - protein, 7 aa, Artificial Sequence
  synthetic polypeptide
LSYLNWY

SEQ ID NO: 3448 - protein, 7 aa, Artificial Sequence
  synthetic polypeptide
LTYLNWY

SEQ ID NO: 3449 - protein, 7 aa, Artificial Sequence
  synthetic polypeptide
LSYVNWY

SEQ ID NO: 3450 - protein, 7 aa, Artificial Sequence
  synthetic polypeptide
LSYLNWY

SEQ ID NO: 3451 - protein, 7 aa, Artificial Sequence
  synthetic polypeptide
LSYLNWY

SEQ ID NO: 3452 - protein, 7 aa, Artificial Sequence
  synthetic polypeptide
ISYLNWY

SEQ ID NO: 3453 - protein, 7 aa, Artificial Sequence
  synthetic polypeptide
VSYVNWY

SEQ ID NO: 3454 - protein, 7 aa, Artificial Sequence
  synthetic polypeptide
LTYLNWY

SEQ ID NO: 3455 - protein, 7 aa, Artificial Sequence
  synthetic polypeptide
SSYVNWY

SEQ ID NO: 3456 - protein, 7 aa, Artificial Sequence
  synthetic polypeptide
VSYVNWY

SEQ ID NO: 3457 - protein, 7 aa, Artificial Sequence
  synthetic polypeptide
LSYVNWY

SEQ ID NO: 3458 - protein, 7 aa, Artificial Sequence
  synthetic polypeptide
LTYLNWY

SEQ ID NO: 3459 - protein, 7 aa, Artificial Sequence
  synthetic polypeptide
LSYLNWY

SEQ ID NO: 3460 - protein, 7 aa, Artificial Sequence
  synthetic polypeptide
LTYLNWY

SEQ ID NO: 3461 - protein, 7 aa, Artificial Sequence
  synthetic polypeptide
LTYLNWY

SEQ ID NO: 3462 - protein, 7 aa, Artificial Sequence
  synthetic polypeptide
LTYVNWY

SEQ ID NO: 3463 - protein, 7 aa, Artificial Sequence
  synthetic polypeptide
LTYLNWY

SEQ ID NO: 3464 - protein, 7 aa, Artificial Sequence
  synthetic polypeptide
LSYLNWY

SEQ ID NO: 3465 - protein, 7 aa, Artificial Sequence
  synthetic polypeptide
LSYVNWY

SEQ ID NO: 3466 - protein, 7 aa, Artificial Sequence
  synthetic polypeptide
LSYLNWY

SEQ ID NO: 3467 - protein, 7 aa, Artificial Sequence
  synthetic polypeptide
VSYVNWY

SEQ ID NO: 3468 - protein, 7 aa, Artificial Sequence
  synthetic polypeptide
ISYLNWY

SEQ ID NO: 3469 - protein, 7 aa, Artificial Sequence
  synthetic polypeptide
ISYLNWY

SEQ ID NO: 3470 - protein, 7 aa, Artificial Sequence
  synthetic polypeptide
LTYVNWY

SEQ ID NO: 3471 - protein, 7 aa, Artificial Sequence
  synthetic polypeptide
VSYLNWY

SEQ ID NO: 3472 - protein, 7 aa, Artificial Sequence
  synthetic polypeptide
VSYVNWY

SEQ ID NO: 3473 - protein, 7 aa, Artificial Sequence
  synthetic polypeptide
VSYVNWY

SEQ ID NO: 3474 - protein, 7 aa, Artificial Sequence
  synthetic polypeptide
VTYLNWY

SEQ ID NO: 3475 - protein, 7 aa, Artificial Sequence
  synthetic polypeptide
ISYLNWY

SEQ ID NO: 3476 - protein, 7 aa, Artificial Sequence
  synthetic polypeptide
LSYVNWY

SEQ ID NO: 3477 - protein, 7 aa, Artificial Sequence
  synthetic polypeptide
LTYVNWY

SEQ ID NO: 3478 - protein, 7 aa, Artificial Sequence
  synthetic polypeptide
LSYVNWY

SEQ ID NO: 3479 - protein, 7 aa, Artificial Sequence
  synthetic polypeptide
LTYLNWY

SEQ ID NO: 3480 - protein, 7 aa, Artificial Sequence
  synthetic polypeptide
LTYVNWY

SEQ ID NO: 3481 - protein, 7 aa, Artificial Sequence
  synthetic polypeptide
VSYVNWY

SEQ ID NO: 3482 - protein, 7 aa, Artificial Sequence
  synthetic polypeptide
VSYVNWY

SEQ ID NO: 3483 - protein, 7 aa, Artificial Sequence
  synthetic polypeptide
LSYVNWY

SEQ ID NO: 3484 - protein, 7 aa, Artificial Sequence
  synthetic polypeptide
STYLNWY

SEQ ID NO: 3485 - protein, 7 aa, Artificial Sequence
  synthetic polypeptide
LSYLNWY

SEQ ID NO: 3486 - protein, 7 aa, Artificial Sequence
  synthetic polypeptide
ITYLNWY

SEQ ID NO: 3487 - protein, 7 aa, Artificial Sequence
  synthetic polypeptide
LTYLNWY

SEQ ID NO: 3488 - protein, 7 aa, Artificial Sequence
  synthetic polypeptide
LTYLNWY

SEQ ID NO: 3489 - protein, 7 aa, Artificial Sequence
  synthetic polypeptide
LTYLNWY

SEQ ID NO: 3490 - protein, 7 aa, Artificial Sequence
  synthetic polypeptide
LSYVNWY

SEQ ID NO: 3491 - protein, 7 aa, Artificial Sequence
  synthetic polypeptide
SNYLNWY

SEQ ID NO: 3492 - protein, 7 aa, Artificial Sequence
  synthetic polypeptide
ISYLNWY

SEQ ID NO: 3493 - protein, 7 aa, Artificial Sequence
  synthetic polypeptide
LTYLNWY

SEQ ID NO: 3494 - protein, 7 aa, Artificial Sequence
  synthetic polypeptide
VSYLNWY

SEQ ID NO: 3495 - protein, 7 aa, Artificial Sequence
  synthetic polypeptide
LTYLNWY

SEQ ID NO: 3496 - protein, 7 aa, Artificial Sequence
  synthetic polypeptide
LSYLNWY

SEQ ID NO: 3497 - protein, 7 aa, Artificial Sequence
  synthetic polypeptide
LSYVNWY

SEQ ID NO: 3498 - protein, 7 aa, Artificial Sequence
  synthetic polypeptide
VSYVNWY

SEQ ID NO: 3499 - protein, 7 aa, Artificial Sequence
  synthetic polypeptide
LSYLNWY

SEQ ID NO: 3500 - protein, 7 aa, Artificial Sequence
  synthetic polypeptide
VSYLNWY

SEQ ID NO: 3501 - protein, 7 aa, Artificial Sequence
  synthetic polypeptide
VSYLNWY

SEQ ID NO: 3502 - protein, 7 aa, Artificial Sequence
  synthetic polypeptide
LTYVNWY

SEQ ID NO: 3503 - protein, 7 aa, Artificial Sequence
  synthetic polypeptide
LSYVNWY

SEQ ID NO: 3504 - protein, 7 aa, Artificial Sequence
  synthetic polypeptide
LSYVNWY

SEQ ID NO: 3505 - protein, 7 aa, Artificial Sequence
  synthetic polypeptide
SSYLNWY

SEQ ID NO: 3506 - protein, 7 aa, Artificial Sequence
  synthetic polypeptide
VSYLNWY

SEQ ID NO: 3507 - protein, 7 aa, Artificial Sequence
  synthetic polypeptide
ISYLNWY

SEQ ID NO: 3508 - protein, 7 aa, Artificial Sequence
  synthetic polypeptide
VSYVNWY

SEQ ID NO: 3509 - protein, 7 aa, Artificial Sequence
  synthetic polypeptide
LSYLNWY

SEQ ID NO: 3510 - protein, 7 aa, Artificial Sequence
  synthetic polypeptide
LTYLNWY

SEQ ID NO: 3511 - protein, 7 aa, Artificial Sequence
  synthetic polypeptide
LSYLNWY

SEQ ID NO: 3512 - protein, 7 aa, Artificial Sequence
  synthetic polypeptide
LSYLNWY

SEQ ID NO: 3513 - protein, 7 aa, Artificial Sequence
  synthetic polypeptide
LSYVNWY

SEQ ID NO: 3514 - protein, 7 aa, Artificial Sequence
  synthetic polypeptide
LTYVNWY

SEQ ID NO: 3515 - protein, 7 aa, Artificial Sequence
  synthetic polypeptide
LTYVNWY

SEQ ID NO: 3516 - protein, 7 aa, Artificial Sequence
  synthetic polypeptide
LSYLNWY

SEQ ID NO: 3517 - protein, 7 aa, Artificial Sequence
  synthetic polypeptide
ISYVNWY

SEQ ID NO: 3518 - protein, 7 aa, Artificial Sequence
  synthetic polypeptide
LTYLNWY

SEQ ID NO: 3519 - protein, 7 aa, Artificial Sequence
  synthetic polypeptide
LTYVNWY

SEQ ID NO: 3520 - protein, 7 aa, Artificial Sequence
  synthetic polypeptide
LSYLNWY

SEQ ID NO: 3521 - protein, 7 aa, Artificial Sequence
  synthetic polypeptide
VSYLNWY

SEQ ID NO: 3522 - protein, 7 aa, Artificial Sequence
  synthetic polypeptide
VSYVNWY

SEQ ID NO: 3523 - protein, 7 aa, Artificial Sequence
  synthetic polypeptide
SSYLNWY

SEQ ID NO: 3524 - protein, 7 aa, Artificial Sequence
  synthetic polypeptide
SSYVNWY

SEQ ID NO: 3525 - protein, 7 aa, Artificial Sequence
  synthetic polypeptide
LTYVNWY

SEQ ID NO: 3526 - protein, 7 aa, Artificial Sequence
  synthetic polypeptide
LTYLNWY

SEQ ID NO: 3527 - protein, 7 aa, Artificial Sequence
  synthetic polypeptide
LSYVNWY

SEQ ID NO: 3528 - protein, 7 aa, Artificial Sequence
  synthetic polypeptide
LSYLNWY

SEQ ID NO: 3529 - protein, 7 aa, Artificial Sequence
  synthetic polypeptide
LTYLNWY

SEQ ID NO: 3530 - protein, 7 aa, Artificial Sequence
  synthetic polypeptide
LSYLNWY

SEQ ID NO: 3531 - protein, 7 aa, Artificial Sequence
  synthetic polypeptide
LSYVNWY

SEQ ID NO: 3532 - protein, 7 aa, Artificial Sequence
  synthetic polypeptide
LTYVNWY

SEQ ID NO: 3533 - protein, 7 aa, Artificial Sequence
  synthetic polypeptide
LTYLNWY

SEQ ID NO: 3534 - protein, 7 aa, Artificial Sequence
  synthetic polypeptide
LSYVNWY

SEQ ID NO: 3535 - protein, 7 aa, Artificial Sequence
  synthetic polypeptide
VSYVNWY

SEQ ID NO: 3536 - protein, 7 aa, Artificial Sequence
  synthetic polypeptide
LSYLNWY

SEQ ID NO: 3537 - protein, 7 aa, Artificial Sequence
  synthetic polypeptide
LTYLNWY

SEQ ID NO: 3538 - protein, 7 aa, Artificial Sequence
  synthetic polypeptide
LTYVNWY

SEQ ID NO: 3539 - protein, 7 aa, Artificial Sequence
  synthetic polypeptide
LSYLNWY

SEQ ID NO: 3540 - protein, 7 aa, Artificial Sequence
  synthetic polypeptide
VSYVNWY

SEQ ID NO: 3541 - protein, 7 aa, Artificial Sequence
  synthetic polypeptide
LSYVNWY

SEQ ID NO: 3542 - protein, 7 aa, Artificial Sequence
  synthetic polypeptide
ISYVNWY

SEQ ID NO: 3543 - protein, 7 aa, Artificial Sequence
  synthetic polypeptide
VSYVNWY

SEQ ID NO: 3544 - protein, 7 aa, Artificial Sequence
  synthetic polypeptide
ISYLNWY

SEQ ID NO: 3545 - protein, 7 aa, Artificial Sequence
  synthetic polypeptide
LTYVNWY

SEQ ID NO: 3546 - protein, 7 aa, Artificial Sequence
  synthetic polypeptide
LSYVNWY

SEQ ID NO: 3547 - protein, 7 aa, Artificial Sequence
  synthetic polypeptide
LSYLNWY

SEQ ID NO: 3548 - protein, 7 aa, Artificial Sequence
  synthetic polypeptide
LSYLNWY

SEQ ID NO: 3549 - protein, 7 aa, Artificial Sequence
  synthetic polypeptide
LSYVNWY

SEQ ID NO: 3550 - protein, 7 aa, Artificial Sequence
  synthetic polypeptide
LSYVNWY

SEQ ID NO: 3551 - protein, 7 aa, Artificial Sequence
  synthetic polypeptide
VSYVNWY

SEQ ID NO: 3552 - protein, 7 aa, Artificial Sequence
  synthetic polypeptide
LSYVNWY

SEQ ID NO: 3553 - protein, 7 aa, Artificial Sequence
  synthetic polypeptide
LTYVNWY

SEQ ID NO: 3554 - protein, 7 aa, Artificial Sequence
  synthetic polypeptide
LSYVNWY

SEQ ID NO: 3555 - protein, 7 aa, Artificial Sequence
  synthetic polypeptide
VSYVNWY

SEQ ID NO: 3556 - protein, 7 aa, Artificial Sequence
  synthetic polypeptide
LSYLNWY

SEQ ID NO: 3557 - protein, 7 aa, Artificial Sequence
  synthetic polypeptide
LSYLNWY

SEQ ID NO: 3558 - protein, 7 aa, Artificial Sequence
  synthetic polypeptide
LTYVNWY

SEQ ID NO: 3559 - protein, 7 aa, Artificial Sequence
  synthetic polypeptide
LSYVNWY

SEQ ID NO: 3560 - protein, 7 aa, Artificial Sequence
  synthetic polypeptide
VSYLNWY

SEQ ID NO: 3561 - protein, 7 aa, Artificial Sequence
  synthetic polypeptide
LTYVNWY

SEQ ID NO: 3562 - protein, 7 aa, Artificial Sequence
  synthetic polypeptide
SSYLNWY

SEQ ID NO: 3563 - protein, 7 aa, Artificial Sequence
  synthetic polypeptide
LTYLNWY

SEQ ID NO: 3564 - protein, 7 aa, Artificial Sequence
  synthetic polypeptide
LTYVNWY

SEQ ID NO: 3565 - protein, 7 aa, Artificial Sequence
  synthetic polypeptide
ITYVNWY

SEQ ID NO: 3566 - protein, 7 aa, Artificial Sequence
  synthetic polypeptide
LTYLNWY

SEQ ID NO: 3567 - protein, 7 aa, Artificial Sequence
  synthetic polypeptide
SSYVNWY

SEQ ID NO: 3568 - protein, 7 aa, Artificial Sequence
  synthetic polypeptide
LSYLNWY

SEQ ID NO: 3569 - protein, 7 aa, Artificial Sequence
  synthetic polypeptide
LSFVNWY

SEQ ID NO: 3570 - protein, 7 aa, Artificial Sequence
  synthetic polypeptide
ITYVNWY

SEQ ID NO: 3571 - protein, 7 aa, Artificial Sequence
  synthetic polypeptide
LSYLNWY

SEQ ID NO: 3572 - protein, 7 aa, Artificial Sequence
  synthetic polypeptide
VTYLNWY

SEQ ID NO: 3573 - protein, 7 aa, Artificial Sequence
  synthetic polypeptide
LSYVNWY

SEQ ID NO: 3574 - protein, 7 aa, Artificial Sequence
  synthetic polypeptide
VSYLNWY

SEQ ID NO: 3575 - protein, 7 aa, Artificial Sequence
  synthetic polypeptide
LTYVNWY

SEQ ID NO: 3576 - protein, 7 aa, Artificial Sequence
  synthetic polypeptide
LSYLNWY

SEQ ID NO: 3577 - protein, 7 aa, Artificial Sequence
  synthetic polypeptide
LSYLNWY

SEQ ID NO: 3578 - protein, 7 aa, Artificial Sequence
  synthetic polypeptide
LTYLNWY

SEQ ID NO: 3579 - protein, 7 aa, Artificial Sequence
  synthetic polypeptide
LSYLNWY

SEQ ID NO: 3580 - protein, 7 aa, Artificial Sequence
  synthetic polypeptide
ISYLNWY

SEQ ID NO: 3581 - protein, 7 aa, Artificial Sequence
  synthetic polypeptide
LSYVNWY

SEQ ID NO: 3582 - protein, 7 aa, Artificial Sequence
  synthetic polypeptide
LTYLNWY

SEQ ID NO: 3583 - protein, 7 aa, Artificial Sequence
  synthetic polypeptide
VSYVNWY

SEQ ID NO: 3584 - protein, 7 aa, Artificial Sequence
  synthetic polypeptide
LTYLNWY

SEQ ID NO: 3585 - protein, 7 aa, Artificial Sequence
  synthetic polypeptide
LSYLNWY

SEQ ID NO: 3586 - protein, 7 aa, Artificial Sequence
  synthetic polypeptide
LSYLNWY

SEQ ID NO: 3587 - protein, 7 aa, Artificial Sequence
  synthetic polypeptide
LTYVNWY

SEQ ID NO: 3588 - protein, 7 aa, Artificial Sequence
  synthetic polypeptide
LSYVNWY

SEQ ID NO: 3589 - protein, 7 aa, Artificial Sequence
  synthetic polypeptide
VSYLNWY

SEQ ID NO: 3590 - protein, 7 aa, Artificial Sequence
  synthetic polypeptide
ITYLNWY

SEQ ID NO: 3591 - protein, 7 aa, Artificial Sequence
  synthetic polypeptide
ITYLNWY

SEQ ID NO: 3592 - protein, 7 aa, Artificial Sequence
  synthetic polypeptide
LTYVNWY

SEQ ID NO: 3593 - protein, 7 aa, Artificial Sequence
  synthetic polypeptide
LTYLNWY

SEQ ID NO: 3594 - protein, 7 aa, Artificial Sequence
  synthetic polypeptide
VTYLNWY

SEQ ID NO: 3595 - protein, 7 aa, Artificial Sequence
  synthetic polypeptide
LTYLNWY

SEQ ID NO: 3596 - protein, 7 aa, Artificial Sequence
  synthetic polypeptide
VTYLNWY

SEQ ID NO: 3597 - protein, 7 aa, Artificial Sequence
  synthetic polypeptide
LSYLNWY

SEQ ID NO: 3598 - protein, 7 aa, Artificial Sequence
  synthetic polypeptide
LSYVNWY

SEQ ID NO: 3599 - protein, 7 aa, Artificial Sequence
  synthetic polypeptide
VSYVNWY

SEQ ID NO: 3600 - protein, 7 aa, Artificial Sequence
  synthetic polypeptide
ISYVNWY

SEQ ID NO: 3601 - protein, 7 aa, Artificial Sequence
  synthetic polypeptide
LTYVNWY

SEQ ID NO: 3602 - protein, 7 aa, Artificial Sequence
  synthetic polypeptide
LSYVNWY

SEQ ID NO: 3603 - protein, 7 aa, Artificial Sequence
  synthetic polypeptide
LTYLNWY

SEQ ID NO: 3604 - protein, 7 aa, Artificial Sequence
  synthetic polypeptide
VSYLNWY

SEQ ID NO: 3605 - protein, 7 aa, Artificial Sequence
  synthetic polypeptide
LTYVNWY

SEQ ID NO: 3606 - protein, 7 aa, Artificial Sequence
  synthetic polypeptide
VSYVNWY

SEQ ID NO: 3607 - protein, 7 aa, Artificial Sequence
  synthetic polypeptide
LSYLNWY

SEQ ID NO: 3608 - protein, 7 aa, Artificial Sequence
  synthetic polypeptide
LSYVNWY

SEQ ID NO: 3609 - protein, 7 aa, Artificial Sequence
  synthetic polypeptide
VSYVNWY

SEQ ID NO: 3610 - protein, 7 aa, Artificial Sequence
  synthetic polypeptide
ITYVNWY

SEQ ID NO: 3611 - protein, 7 aa, Artificial Sequence
  synthetic polypeptide
SSYLNWY

SEQ ID NO: 3612 - protein, 7 aa, Artificial Sequence
  synthetic polypeptide
LSYVNWY

SEQ ID NO: 3613 - protein, 7 aa, Artificial Sequence
  synthetic polypeptide
SYYLNWY

SEQ ID NO: 3614 - protein, 7 aa, Artificial Sequence
  synthetic polypeptide
ITYLNWY

SEQ ID NO: 3615 - protein, 7 aa, Artificial Sequence
  synthetic polypeptide
LTYLNWY

SEQ ID NO: 3616 - protein, 10 aa, Artificial Sequence
  synthetic polypeptide
LVIYAVTSRA

SEQ ID NO: 3617 - protein, 10 aa, Artificial Sequence
  synthetic polypeptide
LVIYAATSLA

SEQ ID NO: 3618 - protein, 10 aa, Artificial Sequence
  synthetic polypeptide
LLIYAATSRH

SEQ ID NO: 3619 - protein, 10 aa, Artificial Sequence
  synthetic polypeptide
LVIYAATSRA

SEQ ID NO: 3620 - protein, 10 aa, Artificial Sequence
  synthetic polypeptide
LLIYATTSLA

SEQ ID NO: 3621 - protein, 10 aa, Artificial Sequence
  synthetic polypeptide
LLIYAATSRA

SEQ ID NO: 3622 - protein, 10 aa, Artificial Sequence
  synthetic polypeptide
LVIYATTSRH

SEQ ID NO: 3623 - protein, 10 aa, Artificial Sequence
  synthetic polypeptide
LVIYAVTSRA

SEQ ID NO: 3624 - protein, 10 aa, Artificial Sequence
  synthetic polypeptide
LLIYAATSLA

SEQ ID NO: 3625 - protein, 10 aa, Artificial Sequence
  synthetic polypeptide
LVIYAVTSRA

SEQ ID NO: 3626 - protein, 10 aa, Artificial Sequence
  synthetic polypeptide
LVIYAVTSLA

SEQ ID NO: 3627 - protein, 10 aa, Artificial Sequence
  synthetic polypeptide
LLIYAATSRA

SEQ ID NO: 3628 - protein, 10 aa, Artificial Sequence
  synthetic polypeptide
LVIYAATSRA

SEQ ID NO: 3629 - protein, 10 aa, Artificial Sequence
  synthetic polypeptide
LVIYAATSRA

SEQ ID NO: 3630 - protein, 10 aa, Artificial Sequence
  synthetic polypeptide
LLIYAATSRA

SEQ ID NO: 3631 - protein, 10 aa, Artificial Sequence
  synthetic polypeptide
LLIYAATSLA

SEQ ID NO: 3632 - protein, 10 aa, Artificial Sequence
  synthetic polypeptide
LLIYAATSRA

SEQ ID NO: 3633 - protein, 10 aa, Artificial Sequence
  synthetic polypeptide
LVIYAATSRA

SEQ ID NO: 3634 - protein, 10 aa, Artificial Sequence
  synthetic polypeptide
LVIYAATSLA

SEQ ID NO: 3635 - protein, 10 aa, Artificial Sequence
  synthetic polypeptide
LLIYAATSRA

SEQ ID NO: 3636 - protein, 10 aa, Artificial Sequence
  synthetic polypeptide
LVIYAATSRH

SEQ ID NO: 3637 - protein, 10 aa, Artificial Sequence
  synthetic polypeptide
LLIYATTSRA

SEQ ID NO: 3638 - protein, 10 aa, Artificial Sequence
  synthetic polypeptide
LLIYAVTSRH

SEQ ID NO: 3639 - protein, 10 aa, Artificial Sequence
  synthetic polypeptide
LLIYAATSRA

SEQ ID NO: 3640 - protein, 10 aa, Artificial Sequence
  synthetic polypeptide
LVIYAATSLH

SEQ ID NO: 3641 - protein, 10 aa, Artificial Sequence
  synthetic polypeptide
LLIYAATSRA

SEQ ID NO: 3642 - protein, 10 aa, Artificial Sequence
  synthetic polypeptide
LVIYAATSLA

SEQ ID NO: 3643 - protein, 10 aa, Artificial Sequence
  synthetic polypeptide
LLIYAATSRA

SEQ ID NO: 3644 - protein, 10 aa, Artificial Sequence
  synthetic polypeptide
LLIYAATSRA

SEQ ID NO: 3645 - protein, 10 aa, Artificial Sequence
  synthetic polypeptide
LVIYAATSRH

SEQ ID NO: 3646 - protein, 10 aa, Artificial Sequence
  synthetic polypeptide
LLIYAATSRH

SEQ ID NO: 3647 - protein, 10 aa, Artificial Sequence
  synthetic polypeptide
LLIYAATSRA

SEQ ID NO: 3648 - protein, 10 aa, Artificial Sequence
  synthetic polypeptide
LLIYAATSRA

SEQ ID NO: 3649 - protein, 10 aa, Artificial Sequence
  synthetic polypeptide
LLIYATTSRA

SEQ ID NO: 3650 - protein, 10 aa, Artificial Sequence
  synthetic polypeptide
LVIYAATSRH

SEQ ID NO: 3651 - protein, 10 aa, Artificial Sequence
  synthetic polypeptide
LVIYATTSRH

SEQ ID NO: 3652 - protein, 10 aa, Artificial Sequence
  synthetic polypeptide
LLIYAATSRA

SEQ ID NO: 3653 - protein, 10 aa, Artificial Sequence
  synthetic polypeptide
LLIYAATSRA

SEQ ID NO: 3654 - protein, 10 aa, Artificial Sequence
  synthetic polypeptide
LLIYAATSRA

SEQ ID NO: 3655 - protein, 10 aa, Artificial Sequence
  synthetic polypeptide
LVIYAATSRA

SEQ ID NO: 3656 - protein, 10 aa, Artificial Sequence
  synthetic polypeptide
LLIYATTSRA

SEQ ID NO: 3657 - protein, 10 aa, Artificial Sequence
  synthetic polypeptide
LVIYAVTSRA

SEQ ID NO: 3658 - protein, 10 aa, Artificial Sequence
  synthetic polypeptide
LLIYAATSRH

SEQ ID NO: 3659 - protein, 10 aa, Artificial Sequence
  synthetic polypeptide
LVIYATTSRA

SEQ ID NO: 3660 - protein, 10 aa, Artificial Sequence
  synthetic polypeptide
LLIYAATSRA

SEQ ID NO: 3661 - protein, 10 aa, Artificial Sequence
  synthetic polypeptide
LVIYAVTSRA

SEQ ID NO: 3662 - protein, 10 aa, Artificial Sequence
  synthetic polypeptide
LLIYAASSLQ

SEQ ID NO: 3663 - protein, 10 aa, Artificial Sequence
  synthetic polypeptide
LLIYAATSLA

SEQ ID NO: 3664 - protein, 10 aa, Artificial Sequence
  synthetic polypeptide
LLIYAATSLA

SEQ ID NO: 3665 - protein, 10 aa, Artificial Sequence
  synthetic polypeptide
LVIYAATSRA

SEQ ID NO: 3666 - protein, 10 aa, Artificial Sequence
  synthetic polypeptide
LVIYATTSLH

SEQ ID NO: 3667 - protein, 10 aa, Artificial Sequence
  synthetic polypeptide
LVIYAATSRH

SEQ ID NO: 3668 - protein, 10 aa, Artificial Sequence
  synthetic polypeptide
LVIYAATSRH

SEQ ID NO: 3669 - protein, 10 aa, Artificial Sequence
  synthetic polypeptide
LVIYAATSRA

SEQ ID NO: 3670 - protein, 10 aa, Artificial Sequence
  synthetic polypeptide
LLIYATTSRA

SEQ ID NO: 3671 - protein, 10 aa, Artificial Sequence
  synthetic polypeptide
LLIYAATSRA

SEQ ID NO: 3672 - protein, 10 aa, Artificial Sequence
  synthetic polypeptide
LLIYAASSLQ

SEQ ID NO: 3673 - protein, 10 aa, Artificial Sequence
  synthetic polypeptide
LVIYATTSRA

SEQ ID NO: 3674 - protein, 10 aa, Artificial Sequence
  synthetic polypeptide
LVIYAATSRH

SEQ ID NO: 3675 - protein, 10 aa, Artificial Sequence
  synthetic polypeptide
LVIYAATSLA

SEQ ID NO: 3676 - protein, 10 aa, Artificial Sequence
  synthetic polypeptide
LLIYAATSRA

SEQ ID NO: 3677 - protein, 10 aa, Artificial Sequence
  synthetic polypeptide
LLIYAASSLQ

SEQ ID NO: 3678 - protein, 10 aa, Artificial Sequence
  synthetic polypeptide
LVIYAATSLA

SEQ ID NO: 3679 - protein, 10 aa, Artificial Sequence
  synthetic polypeptide
LLIYATTSLH

SEQ ID NO: 3680 - protein, 10 aa, Artificial Sequence
  synthetic polypeptide
LLIYAATSRA

SEQ ID NO: 3681 - protein, 10 aa, Artificial Sequence
  synthetic polypeptide
LLIYAATSRA

SEQ ID NO: 3682 - protein, 10 aa, Artificial Sequence
  synthetic polypeptide
LVIYAATSRA

SEQ ID NO: 3683 - protein, 10 aa, Artificial Sequence
  synthetic polypeptide
LLIYAATSRH

SEQ ID NO: 3684 - protein, 10 aa, Artificial Sequence
  synthetic polypeptide
LVIYAATSRA

SEQ ID NO: 3685 - protein, 10 aa, Artificial Sequence
  synthetic polypeptide
LVIYATTSRA

SEQ ID NO: 3686 - protein, 10 aa, Artificial Sequence
  synthetic polypeptide
LLIYAVTSRA

SEQ ID NO: 3687 - protein, 10 aa, Artificial Sequence
  synthetic polypeptide
LLIYAATSRA

SEQ ID NO: 3688 - protein, 10 aa, Artificial Sequence
  synthetic polypeptide
LLIYAASSLQ

SEQ ID NO: 3689 - protein, 10 aa, Artificial Sequence
  synthetic polypeptide
LLIYAATSLA

SEQ ID NO: 3690 - protein, 10 aa, Artificial Sequence
  synthetic polypeptide
LVIYAATSRA

SEQ ID NO: 3691 - protein, 10 aa, Artificial Sequence
  synthetic polypeptide
LVIYAATSRA

SEQ ID NO: 3692 - protein, 10 aa, Artificial Sequence
  synthetic polypeptide
LVIYAVTSRH

SEQ ID NO: 3693 - protein, 10 aa, Artificial Sequence
  synthetic polypeptide
LVIYAATSRA

SEQ ID NO: 3694 - protein, 10 aa, Artificial Sequence
  synthetic polypeptide
LVIYAATSRA

SEQ ID NO: 3695 - protein, 10 aa, Artificial Sequence
  synthetic polypeptide
LLIYAVTSRH

SEQ ID NO: 3696 - protein, 10 aa, Artificial Sequence
  synthetic polypeptide
LLIYAATSRA

SEQ ID NO: 3697 - protein, 10 aa, Artificial Sequence
  synthetic polypeptide
LLIYAATSRH

SEQ ID NO: 3698 - protein, 10 aa, Artificial Sequence
  synthetic polypeptide
LVIYGATSRA

SEQ ID NO: 3699 - protein, 10 aa, Artificial Sequence
  synthetic polypeptide
LLIYAVTSRA

SEQ ID NO: 3700 - protein, 10 aa, Artificial Sequence
  synthetic polypeptide
LVIYAATSRH

SEQ ID NO: 3701 - protein, 10 aa, Artificial Sequence
  synthetic polypeptide
LVIYAATSRA

SEQ ID NO: 3702 - protein, 10 aa, Artificial Sequence
  synthetic polypeptide
LVIYAATSRA

SEQ ID NO: 3703 - protein, 10 aa, Artificial Sequence
  synthetic polypeptide
LVIYAVTSRA

SEQ ID NO: 3704 - protein, 10 aa, Artificial Sequence
  synthetic polypeptide
LLIYAATSRA

SEQ ID NO: 3705 - protein, 10 aa, Artificial Sequence
  synthetic polypeptide
LLIYAATSRA

SEQ ID NO: 3706 - protein, 10 aa, Artificial Sequence
  synthetic polypeptide
LLIYAVTSRH

SEQ ID NO: 3707 - protein, 10 aa, Artificial Sequence
  synthetic polypeptide
LLIYAVTSRA

SEQ ID NO: 3708 - protein, 10 aa, Artificial Sequence
  synthetic polypeptide
LVIYAATSRA

SEQ ID NO: 3709 - protein, 10 aa, Artificial Sequence
  synthetic polypeptide
LVIYAATSRA

SEQ ID NO: 3710 - protein, 10 aa, Artificial Sequence
  synthetic polypeptide
LLIYTTTSLH

SEQ ID NO: 3711 - protein, 10 aa, Artificial Sequence
  synthetic polypeptide
LLIYAATSRA

SEQ ID NO: 3712 - protein, 10 aa, Artificial Sequence
  synthetic polypeptide
LVIYAVTSRA

SEQ ID NO: 3713 - protein, 10 aa, Artificial Sequence
  synthetic polypeptide
LVIYAATSRA

SEQ ID NO: 3714 - protein, 10 aa, Artificial Sequence
  synthetic polypeptide
LLIYAATSLA

SEQ ID NO: 3715 - protein, 10 aa, Artificial Sequence
  synthetic polypeptide
LLIYATTSRH

SEQ ID NO: 3716 - protein, 10 aa, Artificial Sequence
  synthetic polypeptide
LLIYAATSLA

SEQ ID NO: 3717 - protein, 10 aa, Artificial Sequence
  synthetic polypeptide
LLIYAATSRA

SEQ ID NO: 3718 - protein, 10 aa, Artificial Sequence
  synthetic polypeptide
LLIYAATSRA

SEQ ID NO: 3719 - protein, 10 aa, Artificial Sequence
  synthetic polypeptide
LVIYAATSRA

SEQ ID NO: 3720 - protein, 10 aa, Artificial Sequence
  synthetic polypeptide
LLIYAATSLA

SEQ ID NO: 3721 - protein, 10 aa, Artificial Sequence
  synthetic polypeptide
LVIYAATSRA

SEQ ID NO: 3722 - protein, 10 aa, Artificial Sequence
  synthetic polypeptide
LLIYAVTSRA

SEQ ID NO: 3723 - protein, 10 aa, Artificial Sequence
  synthetic polypeptide
LLIYAATSRA

SEQ ID NO: 3724 - protein, 10 aa, Artificial Sequence
  synthetic polypeptide
LLIYAATSRA

SEQ ID NO: 3725 - protein, 10 aa, Artificial Sequence
  synthetic polypeptide
LLIYATTSRH

SEQ ID NO: 3726 - protein, 10 aa, Artificial Sequence
  synthetic polypeptide
LVIYAATSRA

SEQ ID NO: 3727 - protein, 10 aa, Artificial Sequence
  synthetic polypeptide
LLIYAATSLA

SEQ ID NO: 3728 - protein, 10 aa, Artificial Sequence
  synthetic polypeptide
LVIYAATSRH

SEQ ID NO: 3729 - protein, 10 aa, Artificial Sequence
  synthetic polypeptide
LLIYAATSRA

SEQ ID NO: 3730 - protein, 10 aa, Artificial Sequence
  synthetic polypeptide
LLIYAATSRA

SEQ ID NO: 3731 - protein, 10 aa, Artificial Sequence
  synthetic polypeptide
LLIYAVTSLA

SEQ ID NO: 3732 - protein, 10 aa, Artificial Sequence
  synthetic polypeptide
LVIYAATSRA

SEQ ID NO: 3733 - protein, 10 aa, Artificial Sequence
  synthetic polypeptide
LLIYAATSRA

SEQ ID NO: 3734 - protein, 10 aa, Artificial Sequence
  synthetic polypeptide
LLIYAATSRA

SEQ ID NO: 3735 - protein, 10 aa, Artificial Sequence
  synthetic polypeptide
LLIYAATSLA

SEQ ID NO: 3736 - protein, 10 aa, Artificial Sequence
  synthetic polypeptide
LVIYAATSLA

SEQ ID NO: 3737 - protein, 10 aa, Artificial Sequence
  synthetic polypeptide
LLIYYVTNRQ

SEQ ID NO: 3738 - protein, 10 aa, Artificial Sequence
  synthetic polypeptide
LVIYAATSRA

SEQ ID NO: 3739 - protein, 10 aa, Artificial Sequence
  synthetic polypeptide
LLIYAVTSRA

SEQ ID NO: 3740 - protein, 10 aa, Artificial Sequence
  synthetic polypeptide
LVIYAATSLA

SEQ ID NO: 3741 - protein, 10 aa, Artificial Sequence
  synthetic polypeptide
LVIYAATSRA

SEQ ID NO: 3742 - protein, 10 aa, Artificial Sequence
  synthetic polypeptide
LLIYAATSRA

SEQ ID NO: 3743 - protein, 10 aa, Artificial Sequence
  synthetic polypeptide
LVIYYASNRA

SEQ ID NO: 3744 - protein, 10 aa, Artificial Sequence
  synthetic polypeptide
LVIYATTSLA

SEQ ID NO: 3745 - protein, 10 aa, Artificial Sequence
  synthetic polypeptide
LVIYAATSRA

SEQ ID NO: 3746 - protein, 10 aa, Artificial Sequence
  synthetic polypeptide
LVIYAATSRA

SEQ ID NO: 3747 - protein, 10 aa, Artificial Sequence
  synthetic polypeptide
LLIYAATSRA

SEQ ID NO: 3748 - protein, 10 aa, Artificial Sequence
  synthetic polypeptide
LVIYAATSRA

SEQ ID NO: 3749 - protein, 10 aa, Artificial Sequence
  synthetic polypeptide
LLIYAATSRH

SEQ ID NO: 3750 - protein, 10 aa, Artificial Sequence
  synthetic polypeptide
LVIYATTSRA

SEQ ID NO: 3751 - protein, 10 aa, Artificial Sequence
  synthetic polypeptide
LVIYAATSRA

SEQ ID NO: 3752 - protein, 10 aa, Artificial Sequence
  synthetic polypeptide
LVIYAATSRA

SEQ ID NO: 3753 - protein, 10 aa, Artificial Sequence
  synthetic polypeptide
LLIYVVNNRA

SEQ ID NO: 3754 - protein, 10 aa, Artificial Sequence
  synthetic polypeptide
LVIYAATSRA

SEQ ID NO: 3755 - protein, 10 aa, Artificial Sequence
  synthetic polypeptide
LLIYAVTSRA

SEQ ID NO: 3756 - protein, 10 aa, Artificial Sequence
  synthetic polypeptide
LLIYAATSRA

SEQ ID NO: 3757 - protein, 10 aa, Artificial Sequence
  synthetic polypeptide
LVIYATTSRA

SEQ ID NO: 3758 - protein, 10 aa, Artificial Sequence
  synthetic polypeptide
LVIYAATSRH

SEQ ID NO: 3759 - protein, 10 aa, Artificial Sequence
  synthetic polypeptide
LVIYATTSRA

SEQ ID NO: 3760 - protein, 10 aa, Artificial Sequence
  synthetic polypeptide
LVIYAATSRA

SEQ ID NO: 3761 - protein, 10 aa, Artificial Sequence
  synthetic polypeptide
LVIYAATSLA

SEQ ID NO: 3762 - protein, 10 aa, Artificial Sequence
  synthetic polypeptide
LVIYAATSRH

SEQ ID NO: 3763 - protein, 10 aa, Artificial Sequence
  synthetic polypeptide
LLIYAATSRA

SEQ ID NO: 3764 - protein, 10 aa, Artificial Sequence
  synthetic polypeptide
LVIYATTSRA

SEQ ID NO: 3765 - protein, 10 aa, Artificial Sequence
  synthetic polypeptide
LLIYAATSRA

SEQ ID NO: 3766 - protein, 10 aa, Artificial Sequence
  synthetic polypeptide
LVIYAATSRA

SEQ ID NO: 3767 - protein, 10 aa, Artificial Sequence
  synthetic polypeptide
LVIYAATSLA

SEQ ID NO: 3768 - protein, 10 aa, Artificial Sequence
  synthetic polypeptide
LLIYAATSRH

SEQ ID NO: 3769 - protein, 10 aa, Artificial Sequence
  synthetic polypeptide
LVIYAATSRH

SEQ ID NO: 3770 - protein, 10 aa, Artificial Sequence
  synthetic polypeptide
LVIYAATSRH

SEQ ID NO: 3771 - protein, 10 aa, Artificial Sequence
  synthetic polypeptide
LLIYAVTSRA

SEQ ID NO: 3772 - protein, 10 aa, Artificial Sequence
  synthetic polypeptide
LLIYAATSRH

SEQ ID NO: 3773 - protein, 10 aa, Artificial Sequence
  synthetic polypeptide
LVIYAATSLA

SEQ ID NO: 3774 - protein, 10 aa, Artificial Sequence
  synthetic polypeptide
LVIYAATSRA

SEQ ID NO: 3775 - protein, 10 aa, Artificial Sequence
  synthetic polypeptide
LVIYAATSLA

SEQ ID NO: 3776 - protein, 10 aa, Artificial Sequence
  synthetic polypeptide
LVIYAATSRH

SEQ ID NO: 3777 - protein, 10 aa, Artificial Sequence
  synthetic polypeptide
LVIYAATSRA

SEQ ID NO: 3778 - protein, 10 aa, Artificial Sequence
  synthetic polypeptide
LVIYAATSRA

SEQ ID NO: 3779 - protein, 10 aa, Artificial Sequence
  synthetic polypeptide
LLIYAATSLA

SEQ ID NO: 3780 - protein, 10 aa, Artificial Sequence
  synthetic polypeptide
LVIYAATSRA

SEQ ID NO: 3781 - protein, 10 aa, Artificial Sequence
  synthetic polypeptide
LVIYAATSLA

SEQ ID NO: 3782 - protein, 10 aa, Artificial Sequence
  synthetic polypeptide
LVIYATTSLA

SEQ ID NO: 3783 - protein, 10 aa, Artificial Sequence
  synthetic polypeptide
LLIYAATSLA

SEQ ID NO: 3784 - protein, 10 aa, Artificial Sequence
  synthetic polypeptide
LVIYAATSRA

SEQ ID NO: 3785 - protein, 10 aa, Artificial Sequence
  synthetic polypeptide
LLIYAATSRA

SEQ ID NO: 3786 - protein, 10 aa, Artificial Sequence
  synthetic polypeptide
LVIYAATSRH

SEQ ID NO: 3787 - protein, 10 aa, Artificial Sequence
  synthetic polypeptide
LLIYAATSRA

SEQ ID NO: 3788 - protein, 10 aa, Artificial Sequence
  synthetic polypeptide
LLIYAATSRA

SEQ ID NO: 3789 - protein, 10 aa, Artificial Sequence
  synthetic polypeptide
LLIYAATSRA

SEQ ID NO: 3790 - protein, 10 aa, Artificial Sequence
  synthetic polypeptide
LVIYAVTSRA

SEQ ID NO: 3791 - protein, 10 aa, Artificial Sequence
  synthetic polypeptide
LVIYAATSRA

SEQ ID NO: 3792 - protein, 10 aa, Artificial Sequence
  synthetic polypeptide
LLIYAASSLQ

SEQ ID NO: 3793 - protein, 10 aa, Artificial Sequence
  synthetic polypeptide
LVIYAVTSRA

SEQ ID NO: 3794 - protein, 10 aa, Artificial Sequence
  synthetic polypeptide
LVIYAATSRA

SEQ ID NO: 3795 - protein, 10 aa, Artificial Sequence
  synthetic polypeptide
LLIYAATSRH

SEQ ID NO: 3796 - protein, 10 aa, Artificial Sequence
  synthetic polypeptide
LVIYAATSRA

SEQ ID NO: 3797 - protein, 10 aa, Artificial Sequence
  synthetic polypeptide
LLIYAATSRA

SEQ ID NO: 3798 - protein, 10 aa, Artificial Sequence
  synthetic polypeptide
LLIYAATSRA

SEQ ID NO: 3799 - protein, 10 aa, Artificial Sequence
  synthetic polypeptide
LLIYAATSRH

SEQ ID NO: 3800 - protein, 10 aa, Artificial Sequence
  synthetic polypeptide
LLIYAVTSRA

SEQ ID NO: 3801 - protein, 10 aa, Artificial Sequence
  synthetic polypeptide
LLIYAATSLA

SEQ ID NO: 3802 - protein, 10 aa, Artificial Sequence
  synthetic polypeptide
LVIYAATSRA

SEQ ID NO: 3803 - protein, 10 aa, Artificial Sequence
  synthetic polypeptide
LLIYAATSRA

SEQ ID NO: 3804 - protein, 10 aa, Artificial Sequence
  synthetic polypeptide
LLIYATTSLA

SEQ ID NO: 3805 - protein, 10 aa, Artificial Sequence
  synthetic polypeptide
LVIYAATSRA

SEQ ID NO: 3806 - protein, 10 aa, Artificial Sequence
  synthetic polypeptide
LVIYAATSRA

SEQ ID NO: 3807 - protein, 10 aa, Artificial Sequence
  synthetic polypeptide
LLIYAVTSRA

SEQ ID NO: 3808 - protein, 10 aa, Artificial Sequence
  synthetic polypeptide
LLIYAVTSRA

SEQ ID NO: 3809 - protein, 10 aa, Artificial Sequence
  synthetic polypeptide
LLIYAATSRA

SEQ ID NO: 3810 - protein, 10 aa, Artificial Sequence
  synthetic polypeptide
LVIYAATSRA

SEQ ID NO: 3811 - protein, 10 aa, Artificial Sequence
  synthetic polypeptide
LLIYAATSRA

SEQ ID NO: 3812 - protein, 10 aa, Artificial Sequence
  synthetic polypeptide
LLIYAATSRA

SEQ ID NO: 3813 - protein, 10 aa, Artificial Sequence
  synthetic polypeptide
LLIYAATSLA

SEQ ID NO: 3814 - protein, 10 aa, Artificial Sequence
  synthetic polypeptide
LLIYAATSRH

SEQ ID NO: 3815 - protein, 10 aa, Artificial Sequence
  synthetic polypeptide
LLIYAATSRA

SEQ ID NO: 3816 - protein, 10 aa, Artificial Sequence
  synthetic polypeptide
LLIYAATSLA

SEQ ID NO: 3817 - protein, 10 aa, Artificial Sequence
  synthetic polypeptide
LVIYAATSRA

SEQ ID NO: 3818 - protein, 10 aa, Artificial Sequence
  synthetic polypeptide
LVIYAATSRA

SEQ ID NO: 3819 - protein, 10 aa, Artificial Sequence
  synthetic polypeptide
LLIYAATSRH

SEQ ID NO: 3820 - protein, 10 aa, Artificial Sequence
  synthetic polypeptide
LVIYAATSRA

SEQ ID NO: 3821 - protein, 10 aa, Artificial Sequence
  synthetic polypeptide
LVIYAATSRH

SEQ ID NO: 3822 - protein, 10 aa, Artificial Sequence
  synthetic polypeptide
LLIYAASSLQ

SEQ ID NO: 3823 - protein, 10 aa, Artificial Sequence
  synthetic polypeptide
LLIYAATSRA

SEQ ID NO: 3824 - protein, 10 aa, Artificial Sequence
  synthetic polypeptide
LVIYAATSRA

SEQ ID NO: 3825 - protein, 10 aa, Artificial Sequence
  synthetic polypeptide
LLIYAVTSLA

SEQ ID NO: 3826 - protein, 10 aa, Artificial Sequence
  synthetic polypeptide
LVIYAATSLA

SEQ ID NO: 3827 - protein, 10 aa, Artificial Sequence
  synthetic polypeptide
LLIYAVTSRA

SEQ ID NO: 3828 - protein, 10 aa, Artificial Sequence
  synthetic polypeptide
LLIYAATSRA

SEQ ID NO: 3829 - protein, 10 aa, Artificial Sequence
  synthetic polypeptide
LVIYAATSRA

SEQ ID NO: 3830 - protein, 10 aa, Artificial Sequence
  synthetic polypeptide
LLIYAATSRA

SEQ ID NO: 3831 - protein, 10 aa, Artificial Sequence
  synthetic polypeptide
LVIYAATSRA

SEQ ID NO: 3832 - protein, 10 aa, Artificial Sequence
  synthetic polypeptide
LLIYAATSRA

SEQ ID NO: 3833 - protein, 10 aa, Artificial Sequence
  synthetic polypeptide
LVIYAVTSLA

SEQ ID NO: 3834 - protein, 10 aa, Artificial Sequence
  synthetic polypeptide
LLIYAATSRA

SEQ ID NO: 3835 - protein, 10 aa, Artificial Sequence
  synthetic polypeptide
LVIYATTSRA

SEQ ID NO: 3836 - protein, 10 aa, Artificial Sequence
  synthetic polypeptide
LVIYAATSRA

SEQ ID NO: 3837 - protein, 10 aa, Artificial Sequence
  synthetic polypeptide
LLIYAATSLH

SEQ ID NO: 3838 - protein, 10 aa, Artificial Sequence
  synthetic polypeptide
LLIYAATSRA

SEQ ID NO: 3839 - protein, 10 aa, Artificial Sequence
  synthetic polypeptide
LLIYAATSRA

SEQ ID NO: 3840 - protein, 10 aa, Artificial Sequence
  synthetic polypeptide
LVIYAATSRA

SEQ ID NO: 3841 - protein, 10 aa, Artificial Sequence
  synthetic polypeptide
LVIYAATSRA

SEQ ID NO: 3842 - protein, 10 aa, Artificial Sequence
  synthetic polypeptide
LLIYVVTNRE

SEQ ID NO: 3843 - protein, 10 aa, Artificial Sequence
  synthetic polypeptide
LLIYYVTNRQ

SEQ ID NO: 3844 - protein, 10 aa, Artificial Sequence
  synthetic polypeptide
LVIYAATSRA

SEQ ID NO: 3845 - protein, 10 aa, Artificial Sequence
  synthetic polypeptide
LLIYAATSRA

SEQ ID NO: 3846 - protein, 10 aa, Artificial Sequence
  synthetic polypeptide
LVIYAATSRA

SEQ ID NO: 3847 - protein, 10 aa, Artificial Sequence
  synthetic polypeptide
LVIYAATSRA

SEQ ID NO: 3848 - protein, 10 aa, Artificial Sequence
  synthetic polypeptide
LLIYAATSRA

SEQ ID NO: 3849 - protein, 10 aa, Artificial Sequence
  synthetic polypeptide
LVIYAATSRA

SEQ ID NO: 3850 - protein, 10 aa, Artificial Sequence
  synthetic polypeptide
LVIYAATSRA

SEQ ID NO: 3851 - protein, 10 aa, Artificial Sequence
  synthetic polypeptide
LLIYAATSLA

SEQ ID NO: 3852 - protein, 10 aa, Artificial Sequence
  synthetic polypeptide
LVIYAVTSRA

SEQ ID NO: 3853 - protein, 10 aa, Artificial Sequence
  synthetic polypeptide
LLIYAATSRA

SEQ ID NO: 3854 - protein, 10 aa, Artificial Sequence
  synthetic polypeptide
LLIYAATSLA

SEQ ID NO: 3855 - protein, 10 aa, Artificial Sequence
  synthetic polypeptide
LVIYAATSRA

SEQ ID NO: 3856 - protein, 10 aa, Artificial Sequence
  synthetic polypeptide
LVIYAATSLA

SEQ ID NO: 3857 - protein, 10 aa, Artificial Sequence
  synthetic polypeptide
LVIYAATSRA

SEQ ID NO: 3858 - protein, 10 aa, Artificial Sequence
  synthetic polypeptide
LVIYATTSLA

SEQ ID NO: 3859 - protein, 10 aa, Artificial Sequence
  synthetic polypeptide
LLIYAASSLQ

SEQ ID NO: 3860 - protein, 10 aa, Artificial Sequence
  synthetic polypeptide
LVIYAATSRA

SEQ ID NO: 3861 - protein, 10 aa, Artificial Sequence
  synthetic polypeptide
LLIYAVTSRA

SEQ ID NO: 3862 - protein, 10 aa, Artificial Sequence
  synthetic polypeptide
LVIYYVSNLP

SEQ ID NO: 3863 - protein, 10 aa, Artificial Sequence
  synthetic polypeptide
LVIYAATSRH

SEQ ID NO: 3864 - protein, 8 aa, Artificial Sequence
  synthetic polypeptide
QQSYDSPL

SEQ ID NO: 3865 - protein, 8 aa, Artificial Sequence
  synthetic polypeptide
QQSYESPL

SEQ ID NO: 3866 - protein, 8 aa, Artificial Sequence
  synthetic polypeptide
QQSYENPL

SEQ ID NO: 3867 - protein, 8 aa, Artificial Sequence
  synthetic polypeptide
QQSYESPL

SEQ ID NO: 3868 - protein, 8 aa, Artificial Sequence
  synthetic polypeptide
QQSYDLPL

SEQ ID NO: 3869 - protein, 8 aa, Artificial Sequence
  synthetic polypeptide
QQSYENPL

SEQ ID NO: 3870 - protein, 8 aa, Artificial Sequence
  synthetic polypeptide
QQSYDSPL

SEQ ID NO: 3871 - protein, 8 aa, Artificial Sequence
  synthetic polypeptide
QQSYESPL

SEQ ID NO: 3872 - protein, 8 aa, Artificial Sequence
  synthetic polypeptide
QQSYESPL

SEQ ID NO: 3873 - protein, 8 aa, Artificial Sequence
  synthetic polypeptide
QQSYSLPL

SEQ ID NO: 3874 - protein, 8 aa, Artificial Sequence
  synthetic polypeptide
QQSYDTPL

SEQ ID NO: 3875 - protein, 8 aa, Artificial Sequence
  synthetic polypeptide
QQSDESPL

SEQ ID NO: 3876 - protein, 8 aa, Artificial Sequence
  synthetic polypeptide
QQSYSSPL

SEQ ID NO: 3877 - protein, 8 aa, Artificial Sequence
  synthetic polypeptide
QQSYDTPL

SEQ ID NO: 3878 - protein, 8 aa, Artificial Sequence
  synthetic polypeptide
QQSYDSPL

SEQ ID NO: 3879 - protein, 8 aa, Artificial Sequence
  synthetic polypeptide
QQSYDNPL

SEQ ID NO: 3880 - protein, 8 aa, Artificial Sequence
  synthetic polypeptide
QQSYDNPL

SEQ ID NO: 3881 - protein, 8 aa, Artificial Sequence
  synthetic polypeptide
QQSDDSPL

SEQ ID NO: 3882 - protein, 8 aa, Artificial Sequence
  synthetic polypeptide
QQSYELPL

SEQ ID NO: 3883 - protein, 8 aa, Artificial Sequence
  synthetic polypeptide
QQSDNLPL

SEQ ID NO: 3884 - protein, 8 aa, Artificial Sequence
  synthetic polypeptide
QQSYETPL

SEQ ID NO: 3885 - protein, 8 aa, Artificial Sequence
  synthetic polypeptide
QQSYDSPL

SEQ ID NO: 3886 - protein, 8 aa, Artificial Sequence
  synthetic polypeptide
QQSYNSPL

SEQ ID NO: 3887 - protein, 8 aa, Artificial Sequence
  synthetic polypeptide
QQSYENPL

SEQ ID NO: 3888 - protein, 8 aa, Artificial Sequence
  synthetic polypeptide
QQSYNNPL

SEQ ID NO: 3889 - protein, 8 aa, Artificial Sequence
  synthetic polypeptide
QQSYSTPL

SEQ ID NO: 3890 - protein, 8 aa, Artificial Sequence
  synthetic polypeptide
QQSYNTPL

SEQ ID NO: 3891 - protein, 8 aa, Artificial Sequence
  synthetic polypeptide
QQSYDSPL

SEQ ID NO: 3892 - protein, 8 aa, Artificial Sequence
  synthetic polypeptide
QQSYSTPL

SEQ ID NO: 3893 - protein, 8 aa, Artificial Sequence
  synthetic polypeptide
QQSYESPL

SEQ ID NO: 3894 - protein, 8 aa, Artificial Sequence
  synthetic polypeptide
QQSYDNPL

SEQ ID NO: 3895 - protein, 8 aa, Artificial Sequence
  synthetic polypeptide
QQSYDNPL

SEQ ID NO: 3896 - protein, 8 aa, Artificial Sequence
  synthetic polypeptide
QQSYDNPL

SEQ ID NO: 3897 - protein, 8 aa, Artificial Sequence
  synthetic polypeptide
QQSYETPL

SEQ ID NO: 3898 - protein, 8 aa, Artificial Sequence
  synthetic polypeptide
QQSYSLPL

SEQ ID NO: 3899 - protein, 8 aa, Artificial Sequence
  synthetic polypeptide
QQSYESPL

SEQ ID NO: 3900 - protein, 8 aa, Artificial Sequence
  synthetic polypeptide
QQSDNTPL

SEQ ID NO: 3901 - protein, 8 aa, Artificial Sequence
  synthetic polypeptide
QQSYETPL

SEQ ID NO: 3902 - protein, 8 aa, Artificial Sequence
  synthetic polypeptide
QQSDDTPL

SEQ ID NO: 3903 - protein, 8 aa, Artificial Sequence
  synthetic polypeptide
QQSYENPL

SEQ ID NO: 3904 - protein, 8 aa, Artificial Sequence
  synthetic polypeptide
QQSYDTPL

SEQ ID NO: 3905 - protein, 8 aa, Artificial Sequence
  synthetic polypeptide
QQSYENPL

SEQ ID NO: 3906 - protein, 8 aa, Artificial Sequence
  synthetic polypeptide
QQSYNNPL

SEQ ID NO: 3907 - protein, 8 aa, Artificial Sequence
  synthetic polypeptide
QQSYSSPL

SEQ ID NO: 3908 - protein, 8 aa, Artificial Sequence
  synthetic polypeptide
QQSDDSPL

SEQ ID NO: 3909 - protein, 8 aa, Artificial Sequence
  synthetic polypeptide
QQSYDSPL

SEQ ID NO: 3910 - protein, 8 aa, Artificial Sequence
  synthetic polypeptide
QQSYSTPL

SEQ ID NO: 3911 - protein, 8 aa, Artificial Sequence
  synthetic polypeptide
QQSYNLPL

SEQ ID NO: 3912 - protein, 8 aa, Artificial Sequence
  synthetic polypeptide
QQSYNLPL

SEQ ID NO: 3913 - protein, 8 aa, Artificial Sequence
  synthetic polypeptide
QQSYDNPL

SEQ ID NO: 3914 - protein, 8 aa, Artificial Sequence
  synthetic polypeptide
QQSYDTPL

SEQ ID NO: 3915 - protein, 8 aa, Artificial Sequence
  synthetic polypeptide
QQSYDLPL

SEQ ID NO: 3916 - protein, 8 aa, Artificial Sequence
  synthetic polypeptide
QQSYNTPL

SEQ ID NO: 3917 - protein, 8 aa, Artificial Sequence
  synthetic polypeptide
QQSYDTPL

SEQ ID NO: 3918 - protein, 8 aa, Artificial Sequence
  synthetic polypeptide
QQSYDLPL

SEQ ID NO: 3919 - protein, 8 aa, Artificial Sequence
  synthetic polypeptide
QQSYESPL

SEQ ID NO: 3920 - protein, 8 aa, Artificial Sequence
  synthetic polypeptide
QQSYSTPL

SEQ ID NO: 3921 - protein, 8 aa, Artificial Sequence
  synthetic polypeptide
QQSYETPL

SEQ ID NO: 3922 - protein, 8 aa, Artificial Sequence
  synthetic polypeptide
QQSYDTPL

SEQ ID NO: 3923 - protein, 8 aa, Artificial Sequence
  synthetic polypeptide
QQSDDTPL

SEQ ID NO: 3924 - protein, 8 aa, Artificial Sequence
  synthetic polypeptide
QQSYETPL

SEQ ID NO: 3925 - protein, 8 aa, Artificial Sequence
  synthetic polypeptide
QQSYSTPL

SEQ ID NO: 3926 - protein, 8 aa, Artificial Sequence
  synthetic polypeptide
QQSYDTPL

SEQ ID NO: 3927 - protein, 8 aa, Artificial Sequence
  synthetic polypeptide
QQSYDTPL

SEQ ID NO: 3928 - protein, 8 aa, Artificial Sequence
  synthetic polypeptide
QQSYDSPL

SEQ ID NO: 3929 - protein, 8 aa, Artificial Sequence
  synthetic polypeptide
QQSYDTPL

SEQ ID NO: 3930 - protein, 8 aa, Artificial Sequence
  synthetic polypeptide
QQSYNSPL

SEQ ID NO: 3931 - protein, 8 aa, Artificial Sequence
  synthetic polypeptide
QQSYDNPL

SEQ ID NO: 3932 - protein, 8 aa, Artificial Sequence
  synthetic polypeptide
QQSYDSPL

SEQ ID NO: 3933 - protein, 8 aa, Artificial Sequence
  synthetic polypeptide
QQSNELPL

SEQ ID NO: 3934 - protein, 8 aa, Artificial Sequence
  synthetic polypeptide
QQSYDSPL

SEQ ID NO: 3935 - protein, 8 aa, Artificial Sequence
  synthetic polypeptide
QQSYETPL

SEQ ID NO: 3936 - protein, 8 aa, Artificial Sequence
  synthetic polypeptide
QQSYSTPL

SEQ ID NO: 3937 - protein, 8 aa, Artificial Sequence
  synthetic polypeptide
QQSYSSPL

SEQ ID NO: 3938 - protein, 8 aa, Artificial Sequence
  synthetic polypeptide
QQSDSNPL

SEQ ID NO: 3939 - protein, 8 aa, Artificial Sequence
  synthetic polypeptide
QQSDSTPL

SEQ ID NO: 3940 - protein, 8 aa, Artificial Sequence
  synthetic polypeptide
QQSYDSPL

SEQ ID NO: 3941 - protein, 8 aa, Artificial Sequence
  synthetic polypeptide
QQSDDSPL

SEQ ID NO: 3942 - protein, 8 aa, Artificial Sequence
  synthetic polypeptide
QQSYDLPL

SEQ ID NO: 3943 - protein, 8 aa, Artificial Sequence
  synthetic polypeptide
QQSYSLPL

SEQ ID NO: 3944 - protein, 8 aa, Artificial Sequence
  synthetic polypeptide
QQSYSSPL

SEQ ID NO: 3945 - protein, 8 aa, Artificial Sequence
  synthetic polypeptide
QQSYDNPL

SEQ ID NO: 3946 - protein, 8 aa, Artificial Sequence
  synthetic polypeptide
QQSYDSPL

SEQ ID NO: 3947 - protein, 8 aa, Artificial Sequence
  synthetic polypeptide
QQSYENPL

SEQ ID NO: 3948 - protein, 8 aa, Artificial Sequence
  synthetic polypeptide
QQSYDSPL

SEQ ID NO: 3949 - protein, 8 aa, Artificial Sequence
  synthetic polypeptide
QQSYNNPL

SEQ ID NO: 3950 - protein, 8 aa, Artificial Sequence
  synthetic polypeptide
QQSYNLPL

SEQ ID NO: 3951 - protein, 8 aa, Artificial Sequence
  synthetic polypeptide
QQSYETPL

SEQ ID NO: 3952 - protein, 8 aa, Artificial Sequence
  synthetic polypeptide
QQSYDSPL

SEQ ID NO: 3953 - protein, 8 aa, Artificial Sequence
  synthetic polypeptide
QQSYDLPL

SEQ ID NO: 3954 - protein, 8 aa, Artificial Sequence
  synthetic polypeptide
QQGYDLPL

SEQ ID NO: 3955 - protein, 8 aa, Artificial Sequence
  synthetic polypeptide
QQSYENPL

SEQ ID NO: 3956 - protein, 8 aa, Artificial Sequence
  synthetic polypeptide
QQSYELPL

SEQ ID NO: 3957 - protein, 8 aa, Artificial Sequence
  synthetic polypeptide
QQSYDSPL

SEQ ID NO: 3958 - protein, 8 aa, Artificial Sequence
  synthetic polypeptide
QQSYNNPL

SEQ ID NO: 3959 - protein, 8 aa, Artificial Sequence
  synthetic polypeptide
QQSYSNPL

SEQ ID NO: 3960 - protein, 8 aa, Artificial Sequence
  synthetic polypeptide
QQSYDTPL

SEQ ID NO: 3961 - protein, 8 aa, Artificial Sequence
  synthetic polypeptide
QQSYNLPL

SEQ ID NO: 3962 - protein, 8 aa, Artificial Sequence
  synthetic polypeptide
QQSYDTPL

SEQ ID NO: 3963 - protein, 8 aa, Artificial Sequence
  synthetic polypeptide
QQSYDNPL

SEQ ID NO: 3964 - protein, 8 aa, Artificial Sequence
  synthetic polypeptide
QQSYDTPL

SEQ ID NO: 3965 - protein, 8 aa, Artificial Sequence
  synthetic polypeptide
QQSYESPL

SEQ ID NO: 3966 - protein, 8 aa, Artificial Sequence
  synthetic polypeptide
QQSYELPL

SEQ ID NO: 3967 - protein, 8 aa, Artificial Sequence
  synthetic polypeptide
QQSYDTPL

SEQ ID NO: 3968 - protein, 8 aa, Artificial Sequence
  synthetic polypeptide
QQSYDSPL

SEQ ID NO: 3969 - protein, 8 aa, Artificial Sequence
  synthetic polypeptide
QQSYDSPL

SEQ ID NO: 3970 - protein, 8 aa, Artificial Sequence
  synthetic polypeptide
QQSYDLPL

SEQ ID NO: 3971 - protein, 8 aa, Artificial Sequence
  synthetic polypeptide
QQSYDLPL

SEQ ID NO: 3972 - protein, 8 aa, Artificial Sequence
  synthetic polypeptide
QQSYSSPL

SEQ ID NO: 3973 - protein, 8 aa, Artificial Sequence
  synthetic polypeptide
QQSYETPL

SEQ ID NO: 3974 - protein, 8 aa, Artificial Sequence
  synthetic polypeptide
QQSYENPL

SEQ ID NO: 3975 - protein, 8 aa, Artificial Sequence
  synthetic polypeptide
QQSYESPL

SEQ ID NO: 3976 - protein, 8 aa, Artificial Sequence
  synthetic polypeptide
QQSDNTPL

SEQ ID NO: 3977 - protein, 8 aa, Artificial Sequence
  synthetic polypeptide
QQSYSNPL

SEQ ID NO: 3978 - protein, 8 aa, Artificial Sequence
  synthetic polypeptide
QQSYDTPL

SEQ ID NO: 3979 - protein, 8 aa, Artificial Sequence
  synthetic polypeptide
QQSYESPL

SEQ ID NO: 3980 - protein, 8 aa, Artificial Sequence
  synthetic polypeptide
QQSYNLPL

SEQ ID NO: 3981 - protein, 8 aa, Artificial Sequence
  synthetic polypeptide
QQSYDSPL

SEQ ID NO: 3982 - protein, 8 aa, Artificial Sequence
  synthetic polypeptide
QQSYDNPL

SEQ ID NO: 3983 - protein, 8 aa, Artificial Sequence
  synthetic polypeptide
QQSYDSPL

SEQ ID NO: 3984 - protein, 8 aa, Artificial Sequence
  synthetic polypeptide
QQSYDTPL

SEQ ID NO: 3985 - protein, 8 aa, Artificial Sequence
  synthetic polypeptide
QQSYSSPL

SEQ ID NO: 3986 - protein, 8 aa, Artificial Sequence
  synthetic polypeptide
QQSYNSPL

SEQ ID NO: 3987 - protein, 8 aa, Artificial Sequence
  synthetic polypeptide
QQSYDSPL

SEQ ID NO: 3988 - protein, 8 aa, Artificial Sequence
  synthetic polypeptide
QQSYSTPL

SEQ ID NO: 3989 - protein, 8 aa, Artificial Sequence
  synthetic polypeptide
QQSYDNPL

SEQ ID NO: 3990 - protein, 8 aa, Artificial Sequence
  synthetic polypeptide
QQSYDTPL

SEQ ID NO: 3991 - protein, 8 aa, Artificial Sequence
  synthetic polypeptide
QQSYDSPL

SEQ ID NO: 3992 - protein, 8 aa, Artificial Sequence
  synthetic polypeptide
QQSYDTPL

SEQ ID NO: 3993 - protein, 8 aa, Artificial Sequence
  synthetic polypeptide
QQSYELPL

SEQ ID NO: 3994 - protein, 8 aa, Artificial Sequence
  synthetic polypeptide
QQSYETPL

SEQ ID NO: 3995 - protein, 8 aa, Artificial Sequence
  synthetic polypeptide
QQSYNLPL

SEQ ID NO: 3996 - protein, 8 aa, Artificial Sequence
  synthetic polypeptide
QQSYNSPL

SEQ ID NO: 3997 - protein, 8 aa, Artificial Sequence
  synthetic polypeptide
QQSYDSPL

SEQ ID NO: 3998 - protein, 8 aa, Artificial Sequence
  synthetic polypeptide
QQSYNNPL

SEQ ID NO: 3999 - protein, 8 aa, Artificial Sequence
  synthetic polypeptide
QQSDNTPL

SEQ ID NO: 4000 - protein, 8 aa, Artificial Sequence
  synthetic polypeptide
QQSYESPL

SEQ ID NO: 4001 - protein, 8 aa, Artificial Sequence
  synthetic polypeptide
QQSYENPL

SEQ ID NO: 4002 - protein, 8 aa, Artificial Sequence
  synthetic polypeptide
QQSYSLPL

SEQ ID NO: 4003 - protein, 8 aa, Artificial Sequence
  synthetic polypeptide
QQSYDTPL

SEQ ID NO: 4004 - protein, 8 aa, Artificial Sequence
  synthetic polypeptide
QQSYDNPL

SEQ ID NO: 4005 - protein, 8 aa, Artificial Sequence
  synthetic polypeptide
QQSYESPL

SEQ ID NO: 4006 - protein, 8 aa, Artificial Sequence
  synthetic polypeptide
QQSYDSPL

SEQ ID NO: 4007 - protein, 8 aa, Artificial Sequence
  synthetic polypeptide
QQSYDLPL

SEQ ID NO: 4008 - protein, 8 aa, Artificial Sequence
  synthetic polypeptide
QQSYELPL

SEQ ID NO: 4009 - protein, 8 aa, Artificial Sequence
  synthetic polypeptide
QQSYDTPL

SEQ ID NO: 4010 - protein, 8 aa, Artificial Sequence
  synthetic polypeptide
QQSYNLPL

SEQ ID NO: 4011 - protein, 8 aa, Artificial Sequence
  synthetic polypeptide
QQSYELPL

SEQ ID NO: 4012 - protein, 8 aa, Artificial Sequence
  synthetic polypeptide
QQSYSTPL

SEQ ID NO: 4013 - protein, 8 aa, Artificial Sequence
  synthetic polypeptide
QQSYSTPL

SEQ ID NO: 4014 - protein, 8 aa, Artificial Sequence
  synthetic polypeptide
QQSYNNPL

SEQ ID NO: 4015 - protein, 8 aa, Artificial Sequence
  synthetic polypeptide
QQSYNNPL

SEQ ID NO: 4016 - protein, 8 aa, Artificial Sequence
  synthetic polypeptide
QQSYNNPL

SEQ ID NO: 4017 - protein, 8 aa, Artificial Sequence
  synthetic polypeptide
QQSYNSPL

SEQ ID NO: 4018 - protein, 8 aa, Artificial Sequence
  synthetic polypeptide
QQSYESPL

SEQ ID NO: 4019 - protein, 8 aa, Artificial Sequence
  synthetic polypeptide
QQSYSSPL

SEQ ID NO: 4020 - protein, 8 aa, Artificial Sequence
  synthetic polypeptide
QQSDDSPL

SEQ ID NO: 4021 - protein, 8 aa, Artificial Sequence
  synthetic polypeptide
QQSYDSPL

SEQ ID NO: 4022 - protein, 8 aa, Artificial Sequence
  synthetic polypeptide
QQSYETPL

SEQ ID NO: 4023 - protein, 8 aa, Artificial Sequence
  synthetic polypeptide
QQSYDSPL

SEQ ID NO: 4024 - protein, 8 aa, Artificial Sequence
  synthetic polypeptide
QQSDNTPL

SEQ ID NO: 4025 - protein, 8 aa, Artificial Sequence
  synthetic polypeptide
QQSYDNPL

SEQ ID NO: 4026 - protein, 8 aa, Artificial Sequence
  synthetic polypeptide
QQSYDTPL

SEQ ID NO: 4027 - protein, 8 aa, Artificial Sequence
  synthetic polypeptide
QQSYETPL

SEQ ID NO: 4028 - protein, 8 aa, Artificial Sequence
  synthetic polypeptide
QQSYDTPL

SEQ ID NO: 4029 - protein, 8 aa, Artificial Sequence
  synthetic polypeptide
QQSYSSPL

SEQ ID NO: 4030 - protein, 8 aa, Artificial Sequence
  synthetic polypeptide
QQSYNTPL

SEQ ID NO: 4031 - protein, 8 aa, Artificial Sequence
  synthetic polypeptide
QQSYSLPL

SEQ ID NO: 4032 - protein, 8 aa, Artificial Sequence
  synthetic polypeptide
QQSYDLPL

SEQ ID NO: 4033 - protein, 8 aa, Artificial Sequence
  synthetic polypeptide
QQSYETPL

SEQ ID NO: 4034 - protein, 8 aa, Artificial Sequence
  synthetic polypeptide
QQSYESPL

SEQ ID NO: 4035 - protein, 8 aa, Artificial Sequence
  synthetic polypeptide
QQSYDLPL

SEQ ID NO: 4036 - protein, 8 aa, Artificial Sequence
  synthetic polypeptide
QQSYDSPL

SEQ ID NO: 4037 - protein, 8 aa, Artificial Sequence
  synthetic polypeptide
QQSYNTPL

SEQ ID NO: 4038 - protein, 8 aa, Artificial Sequence
  synthetic polypeptide
QQSYNSPL

SEQ ID NO: 4039 - protein, 8 aa, Artificial Sequence
  synthetic polypeptide
QQSYDTPL

SEQ ID NO: 4040 - protein, 8 aa, Artificial Sequence
  synthetic polypeptide
QQSYNNPL

SEQ ID NO: 4041 - protein, 8 aa, Artificial Sequence
  synthetic polypeptide
QQSYETPL

SEQ ID NO: 4042 - protein, 8 aa, Artificial Sequence
  synthetic polypeptide
QQSYDSPL

SEQ ID NO: 4043 - protein, 8 aa, Artificial Sequence
  synthetic polypeptide
QQSYDSPL

SEQ ID NO: 4044 - protein, 8 aa, Artificial Sequence
  synthetic polypeptide
QQSYDSPL

SEQ ID NO: 4045 - protein, 8 aa, Artificial Sequence
  synthetic polypeptide
QQSYDSPL

SEQ ID NO: 4046 - protein, 8 aa, Artificial Sequence
  synthetic polypeptide
QQSYDLPL

SEQ ID NO: 4047 - protein, 8 aa, Artificial Sequence
  synthetic polypeptide
QQSYNNPL

SEQ ID NO: 4048 - protein, 8 aa, Artificial Sequence
  synthetic polypeptide
QQSYDLPL

SEQ ID NO: 4049 - protein, 8 aa, Artificial Sequence
  synthetic polypeptide
QQSYETPL

SEQ ID NO: 4050 - protein, 8 aa, Artificial Sequence
  synthetic polypeptide
QQSYDTPL

SEQ ID NO: 4051 - protein, 8 aa, Artificial Sequence
  synthetic polypeptide
QQSYDLPL

SEQ ID NO: 4052 - protein, 8 aa, Artificial Sequence
  synthetic polypeptide
QQSYNSPL

SEQ ID NO: 4053 - protein, 8 aa, Artificial Sequence
  synthetic polypeptide
QQSYDNPL

SEQ ID NO: 4054 - protein, 8 aa, Artificial Sequence
  synthetic polypeptide
QQSYETPL

SEQ ID NO: 4055 - protein, 8 aa, Artificial Sequence
  synthetic polypeptide
QQSYDLPL

SEQ ID NO: 4056 - protein, 8 aa, Artificial Sequence
  synthetic polypeptide
QQSYESPL

SEQ ID NO: 4057 - protein, 8 aa, Artificial Sequence
  synthetic polypeptide
QQSYDTPL

SEQ ID NO: 4058 - protein, 8 aa, Artificial Sequence
  synthetic polypeptide
QQSYDNPL

SEQ ID NO: 4059 - protein, 8 aa, Artificial Sequence
  synthetic polypeptide
QQSYDSPL

SEQ ID NO: 4060 - protein, 8 aa, Artificial Sequence
  synthetic polypeptide
QQSYNSPL

SEQ ID NO: 4061 - protein, 8 aa, Artificial Sequence
  synthetic polypeptide
QQSYSSPL

SEQ ID NO: 4062 - protein, 8 aa, Artificial Sequence
  synthetic polypeptide
QQSYESPL

SEQ ID NO: 4063 - protein, 8 aa, Artificial Sequence
  synthetic polypeptide
QQSYSTPL

SEQ ID NO: 4064 - protein, 8 aa, Artificial Sequence
  synthetic polypeptide
QQSYDLPL

SEQ ID NO: 4065 - protein, 8 aa, Artificial Sequence
  synthetic polypeptide
QQSYNLPL

SEQ ID NO: 4066 - protein, 8 aa, Artificial Sequence
  synthetic polypeptide
QQSYNTPL

SEQ ID NO: 4067 - protein, 8 aa, Artificial Sequence
  synthetic polypeptide
QQSYDLPL

SEQ ID NO: 4068 - protein, 8 aa, Artificial Sequence
  synthetic polypeptide
QQSYDSPL

SEQ ID NO: 4069 - protein, 8 aa, Artificial Sequence
  synthetic polypeptide
QQSYENPL

SEQ ID NO: 4070 - protein, 8 aa, Artificial Sequence
  synthetic polypeptide
QQSYELPL

SEQ ID NO: 4071 - protein, 8 aa, Artificial Sequence
  synthetic polypeptide
QQSYNSPL

SEQ ID NO: 4072 - protein, 8 aa, Artificial Sequence
  synthetic polypeptide
QQSYDNPL

SEQ ID NO: 4073 - protein, 8 aa, Artificial Sequence
  synthetic polypeptide
QQSYESPL

SEQ ID NO: 4074 - protein, 8 aa, Artificial Sequence
  synthetic polypeptide
QQSYDNPL

SEQ ID NO: 4075 - protein, 8 aa, Artificial Sequence
  synthetic polypeptide
QQSYDLPL

SEQ ID NO: 4076 - protein, 8 aa, Artificial Sequence
  synthetic polypeptide
QQSYDSPL

SEQ ID NO: 4077 - protein, 8 aa, Artificial Sequence
  synthetic polypeptide
QQSYDSPL

SEQ ID NO: 4078 - protein, 8 aa, Artificial Sequence
  synthetic polypeptide
QQSYDNPL

SEQ ID NO: 4079 - protein, 8 aa, Artificial Sequence
  synthetic polypeptide
QQSYNLPL

SEQ ID NO: 4080 - protein, 8 aa, Artificial Sequence
  synthetic polypeptide
QQSYETPL

SEQ ID NO: 4081 - protein, 8 aa, Artificial Sequence
  synthetic polypeptide
QQSYDLPL

SEQ ID NO: 4082 - protein, 8 aa, Artificial Sequence
  synthetic polypeptide
QQSYDLPL

SEQ ID NO: 4083 - protein, 8 aa, Artificial Sequence
  synthetic polypeptide
QQSYDSPL

SEQ ID NO: 4084 - protein, 8 aa, Artificial Sequence
  synthetic polypeptide
QQSYELPL

SEQ ID NO: 4085 - protein, 8 aa, Artificial Sequence
  synthetic polypeptide
QQSYDTPL

SEQ ID NO: 4086 - protein, 8 aa, Artificial Sequence
  synthetic polypeptide
QQSYDTPL

SEQ ID NO: 4087 - protein, 8 aa, Artificial Sequence
  synthetic polypeptide
QQSYSTPL

SEQ ID NO: 4088 - protein, 8 aa, Artificial Sequence
  synthetic polypeptide
QQSYETPL

SEQ ID NO: 4089 - protein, 8 aa, Artificial Sequence
  synthetic polypeptide
QQSDDSPL

SEQ ID NO: 4090 - protein, 8 aa, Artificial Sequence
  synthetic polypeptide
QQSYETPL

SEQ ID NO: 4091 - protein, 8 aa, Artificial Sequence
  synthetic polypeptide
QQSYSIPL

SEQ ID NO: 4092 - protein, 8 aa, Artificial Sequence
  synthetic polypeptide
QQSYDSPL

SEQ ID NO: 4093 - protein, 8 aa, Artificial Sequence
  synthetic polypeptide
QQSYESPL

SEQ ID NO: 4094 - protein, 8 aa, Artificial Sequence
  synthetic polypeptide
QQSYDTPL

SEQ ID NO: 4095 - protein, 8 aa, Artificial Sequence
  synthetic polypeptide
QQSYDTPL

SEQ ID NO: 4096 - protein, 8 aa, Artificial Sequence
  synthetic polypeptide
QQSYELPL

SEQ ID NO: 4097 - protein, 8 aa, Artificial Sequence
  synthetic polypeptide
QQSYDLPL

SEQ ID NO: 4098 - protein, 8 aa, Artificial Sequence
  synthetic polypeptide
QQSYDLPL

SEQ ID NO: 4099 - protein, 8 aa, Artificial Sequence
  synthetic polypeptide
QQSYDNPL

SEQ ID NO: 4100 - protein, 8 aa, Artificial Sequence
  synthetic polypeptide
QQSYDSPL

SEQ ID NO: 4101 - protein, 8 aa, Artificial Sequence
  synthetic polypeptide
QQSYDSPL

SEQ ID NO: 4102 - protein, 8 aa, Artificial Sequence
  synthetic polypeptide
QQSYDTPL

SEQ ID NO: 4103 - protein, 8 aa, Artificial Sequence
  synthetic polypeptide
QQSYNNPL

SEQ ID NO: 4104 - protein, 8 aa, Artificial Sequence
  synthetic polypeptide
QQSYDLPL

SEQ ID NO: 4105 - protein, 8 aa, Artificial Sequence
  synthetic polypeptide
QQSYDSPL

SEQ ID NO: 4106 - protein, 8 aa, Artificial Sequence
  synthetic polypeptide
QQSYSSPL

SEQ ID NO: 4107 - protein, 8 aa, Artificial Sequence
  synthetic polypeptide
QQSYSTPL

SEQ ID NO: 4108 - protein, 8 aa, Artificial Sequence
  synthetic polypeptide
QQSYDTPL

SEQ ID NO: 4109 - protein, 8 aa, Artificial Sequence
  synthetic polypeptide
QQSYDNPL

SEQ ID NO: 4110 - protein, 8 aa, Artificial Sequence
  synthetic polypeptide
QQSYDSPL

SEQ ID NO: 4111 - protein, 8 aa, Artificial Sequence
  synthetic polypeptide
QQSYDSPL

SEQ ID NO: 4112 - protein, 120 aa, Artificial Sequence
  synthetic polypeptide
EVQLLESGGGLVQPGGSLRLSCAASGFTFSSYSMNWVRQAPGKGLEWVANINYNGGYTSYADSVKGRFTISRDNSKNTLYLQMNSLRAEDTAVYYCAKSATWHDTHLDYWGQGTLVTVSS

SEQ ID NO: 4113 - protein, 120 aa, Artificial Sequence
  synthetic polypeptide
EVQLLESGGGLVQPGGSLRLSCAASGFTFSSYSMNWVRQAPGKGLEWVAGINYNGGYKGYADSVKGRFTISRDNSKNTLYLQMNSLRAEDTAVYYCARSATWHDTALDYWGQGTLVTVSS

SEQ ID NO: 4114 - protein, 120 aa, Artificial Sequence
  synthetic polypeptide
EVQLLESGGGLVQPGGSLRLSCAASGFTFDSYGMNWVRQAPGKGLEWVAGINYNGGYTGYADSVKGRFTISRDNSKNTLYLQMNSLRAEDTAVYYCARSATWHDTALDYWGQGTLVTVSS

SEQ ID NO: 4115 - protein, 120 aa, Artificial Sequence
  synthetic polypeptide
EVQLLESGGGLVQPGGSLRLSCAASGFTFSSYGMNWVRQAPGKGLEWVAGINYNGGYTSYADSVKGRFTISRDNSKNTLYLQMNSLRAEDTAVYYCARSATWHDTALDYWGQGTLVTVSS

SEQ ID NO: 4116 - protein, 120 aa, Artificial Sequence
  synthetic polypeptide
EVQLLESGGGLVQPGGSLRLSCAASGFTFDSYGMNWVRQAPGKGLEWVAGINYNSGYTSYADSVKGRFTISRDNSKNTLYLQMNSLRAEDTAVYYCARSATWHDTALDYWGQGTLVTVSS

SEQ ID NO: 4117 - protein, 120 aa, Artificial Sequence
  synthetic polypeptide
EVQLLESGGGLVQPGGSLRLSCAASGFTFSSYGMNWVRQAPGKGLEWVAGINYNSGYTSYADSVKGRFTISRDNSKNTLYLQMNSLRAEDTAVYYCARSATWHDTALDYWGQGTLVTVSS

SEQ ID NO: 4118 - protein, 120 aa, Artificial Sequence
  synthetic polypeptide
EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSATWHDTALDYWGQGTLVTVSS

SEQ ID NO: 4119 - protein, 120 aa, Artificial Sequence; identical to SEQ ID NO: 4118
  synthetic polypeptide

SEQ ID NO: 4120 - protein, 120 aa, Artificial Sequence
  synthetic polypeptide
EVQLLESGGGLVQPGGSLRLSCAASGFTFDSYGMNWVRQAPGKGLEWVANINYNGGYTSYADSVKGRFTISRDNSKNTLYLQMNSLRAEDTAVYYCARSATWHDTALDYWGQGTLVTVSS

SEQ ID NO: 4121 - protein, 120 aa, Artificial Sequence
  synthetic polypeptide
EVQLLESGGGLVQPGGSLRLSCAASGFTFSSYSMNWVRQAPGKGLEWVANINYNGGYTSYADSVKGRFTISRDNSKNTLYLQMNSLRAEDTAVYYCARSATWHDTALDYWGQGTLVTVSS

SEQ ID NO: 4122 - protein, 120 aa, Artificial Sequence
  synthetic polypeptide
EVQLLESGGGLVQPGGSLRLSCAASGFTFSSYGMNWVRQAPGKGLEWVASINYNGGYTGYADSVKGRFTISRDNSKNTLYLQMNSLRAEDTAVYYCARSATWHDTALDYWGQGTLVTVSS

SEQ ID NO: 4123 - protein, 120 aa, Artificial Sequence
  synthetic polypeptide
EVQLLESGGGLVQPGGSLRLSCAASGFTFSDYGMNWVRQAPGKGLEWVASINYNGGYTSYADSVKGRFTISRDNSKNTLYLQMNSLRAEDTAVYYCARSATWHDTALDYWGQGTLVTVSS

SEQ ID NO: 4124 - protein, 120 aa, Artificial Sequence
  synthetic polypeptide
EVQLLESGGGLVQPGGSLRLSCAASGFTFDSYGMNWVRQAPGKGLEWVSGINYNSGYKSYADSVKGRFTISRDNSKNTLYLQMNSLRAEDTAVYYCARSATWHDTALDYWGQGTLVTVSS

SEQ ID NO: 4125 - protein, 120 aa, Artificial Sequence
  synthetic polypeptide
EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSATWHDTALDYWGQGTLVTVSS

SEQ ID NO: 4126 - protein, 120 aa, Artificial Sequence; identical to SEQ ID NO: 4125
  synthetic polypeptide

SEQ ID NO: 4127 - protein, 120 aa, Artificial Sequence
  synthetic polypeptide
EVQLLESGGGLVQPGGSLRLSCAASGFTFSSYSMNWVRQAPGKGLEWVSNINYNGGYKSYADSVKGRFTISRDNSKNTLYLQMNSLRAEDTAVYYCARSATWHDTALDYWGQGTLVTVSS

SEQ ID NO: 4128 - protein, 120 aa, Artificial Sequence; identical to SEQ ID NO: 4127
  synthetic polypeptide

SEQ ID NO: 4129 - protein, 120 aa, Artificial Sequence
  synthetic polypeptide
EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSATWHDTALDYWGQGTLVTVSS

SEQ ID NO: 4130 - protein, 120 aa, Artificial Sequence
  synthetic polypeptide
EVQLLESGGGLVQPGGSLRLSCAASGFTFDSYSMNWVRQAPGKGLEWVAGINYNGGYKGYADSVKGRFTISRDNSKNTLYLQMNSLRAEDTAVYYCARSATWHDTHLDYWGQGTLVTVSS

SEQ ID NO: 4131 - protein, 120 aa, Artificial Sequence
  synthetic polypeptide
EVQLLESGGGLVQPGGSLRLSCAASGFTFDDYSMNWVRQAPGKGLEWVAGINYNGGYKSYADSVKGRFTISRDNSKNTLYLQMNSLRAEDTAVYYCARSATWHDTHLDYWGQGTLVTVSS

SEQ ID NO: 4132 - protein, 120 aa, Artificial Sequence
  synthetic polypeptide
EVQLLESGGGLVQPGGSLRLSCAASGFTFDSYSMNWVRQAPGKGLEWVAGINYNGGYKSYADSVKGRFTISRDNSKNTLYLQMNSLRAEDTAVYYCARSATWHDTHLDYWGQGTLVTVSS

SEQ ID NO: 4133 - protein, 120 aa, Artificial Sequence; identical to SEQ ID NO: 4132
  synthetic polypeptide

SEQ ID NO: 4134 - protein, 120 aa, Artificial Sequence
  synthetic polypeptide
EVQLLESGGGLVQPGGSLRLSCAASGFTFSSYSMNWVRQAPGKGLEWVAGINYNGGYKSYADSVKGRFTISRDNSKNTLYLQMNSLRAEDTAVYYCARSATWHDTHLDYWGQGTLVTVSS

SEQ ID NO: 4135 - protein, 120 aa, Artificial Sequence
  synthetic polypeptide
EVQLLESGGGLVQPGGSLRLSCAASGFTFDSYSMNWVRQAPGKGLEWVAGINYNGGYTGYADSVKGRFTISRDNSKNTLYLQMNSLRAEDTAVYYCARSATWHDTHLDYWGQGTLVTVSS

SEQ ID NO: 4136 - protein, 120 aa, Artificial Sequence; identical to SEQ ID NO: 4135
  synthetic polypeptide

SEQ ID NO: 4137 - protein, 120 aa, Artificial Sequence
  synthetic polypeptide
EVQLLESGGGLVQPGGSLRLSCAASGFTFSSYGMNWVRQAPGKGLEWVAGINYNGGYTGYADSVKGRFTISRDNSKNTLYLQMNSLRAEDTAVYYCARSATWHDTHLDYWGQGTLVTVSS

SEQ ID NO: 4138 - protein, 120 aa, Artificial Sequence
  synthetic polypeptide
EVQLLESGGGLVQPGGSLRLSCAASGFTFSSYSMNWVRQAPGKGLEWVAGINYNGGYTGYADSVKGRFTISRDNSKNTLYLQMNSLRAEDTAVYYCARSATWHDTHLDYWGQGTLVTVSS

SEQ ID NO: 4139 - protein, 120 aa, Artificial Sequence; identical to SEQ ID NO: 4138
  synthetic polypeptide

SEQ ID NO: 4140 - protein, 120 aa, Artificial Sequence; identical to SEQ ID NO: 4138
  synthetic polypeptide

SEQ ID NO: 4141 - protein, 120 aa, Artificial Sequence; identical to SEQ ID NO: 4138
  synthetic polypeptide

SEQ ID NO: 4142 - protein, 120 aa, Artificial Sequence
  synthetic polypeptide
EVQLLESGGGLVQPGGSLRLSCAASGFTFDSYGMNWVRQAPGKGLEWVAGINYNGGYTSYADSVKGRFTISRDNSKNTLYLQMNSLRAEDTAVYYCARSATWHDTHLDYWGQGTLVTVSS

SEQ ID NO: 4143 - protein, 120 aa, Artificial Sequence
  synthetic polypeptide
EVQLLESGGGLVQPGGSLRLSCAASGFTFDSYSMNWVRQAPGKGLEWVAGINYNGGYTSYADSVKGRFTISRDNSKNTLYLQMNSLRAEDTAVYYCARSATWHDTHLDYWGQGTLVTVSS

SEQ ID NO: 4144 - protein, 120 aa, Artificial Sequence; identical to SEQ ID NO: 4143
  synthetic polypeptide

SEQ ID NO: 4145 - protein, 120 aa, Artificial Sequence; identical to SEQ ID NO: 4143
  synthetic polypeptide

SEQ ID NO: 4146 - protein, 120 aa, Artificial Sequence; identical to SEQ ID NO: 4143
  synthetic polypeptide

SEQ ID NO: 4147 - protein, 120 aa, Artificial Sequence; identical to SEQ ID NO: 4143
  synthetic polypeptide

SEQ ID NO: 4148 - protein, 120 aa, Artificial Sequence
  synthetic polypeptide
EVQLLESGGGLVQPGGSLRLSCAASGFTFSDYGMNWVRQAPGKGLEWVAGINYNGGYTSYADSVKGRFTISRDNSKNTLYLQMNSLRAEDTAVYYCARSATWHDTHLDYWGQGTLVTVSS

SEQ ID NO: 4149 - protein, 120 aa, Artificial Sequence
  synthetic polypeptide
EVQLLESGGGLVQPGGSLRLSCAASGFTFSSYGMHWVRQAPGKGLEWVAGINYNGGYTSYADSVKGRFTISRDNSKNTLYLQMNSLRAEDTAVYYCARSATWHDTHLDYWGQGTLVTVSS

SEQ ID NO: 4150 - protein, 120 aa, Artificial Sequence
  synthetic polypeptide
EVQLLESGGGLVQPGGSLRLSCAASGFTFSSYSMNWVRQAPGKGLEWVAGINYNGGYTSYADSVKGRFTISRDNSKNTLYLQMNSLRAEDTAVYYCARSATWHDTHLDYWGQGTLVTVSS

SEQ ID NO: 4151 - protein, 120 aa, Artificial Sequence; identical to SEQ ID NO: 4150
  synthetic polypeptide

SEQ ID NO: 4152 - protein, 120 aa, Artificial Sequence
  synthetic polypeptide
EVQLLESGGGLVQPGGSLRLSCAASGFTFDDYSMNWVRQAPGKGLEWVAGINYNSGYKGYADSVKGRFTISRDNSKNTLYLQMNSLRAEDTAVYYCARSATWHDTHLDYWGQGTLVTVSS

SEQ ID NO: 4153 - protein, 120 aa, Artificial Sequence
  synthetic polypeptide
EVQLLESGGGLVQPGGSLRLSCAASGFTFDSYSMNWVRQAPGKGLEWVAGINYNSGYKGYADSVKGRFTISRDNSKNTLYLQMNSLRAEDTAVYYCARSATWHDTHLDYWGQGTLVTVSS

SEQ ID NO: 4154 - protein, 120 aa, Artificial Sequence; identical to SEQ ID NO: 4153
  synthetic polypeptide

SEQ ID NO: 4155 - protein, 120 aa, Artificial Sequence
  synthetic polypeptide
EVQLLESGGGLVQPGGSLRLSCAASGFTFSSYGMNWVRQAPGKGLEWVAGINYNSGYKGYADSVKGRFTISRDNSKNTLYLQMNSLRAEDTAVYYCARSATWHDTHLDYWGQGTLVTVSS

SEQ ID NO: 4156 - protein, 120 aa, Artificial Sequence
  synthetic polypeptide
EVQLLESGGGLVQPGGSLRLSCAASGFTFSSYSMNWVRQAPGKGLEWVAGINYNSGYKGYADSVKGRFTISRDNSKNTLYLQMNSLRAEDTAVYYCARSATWHDTHLDYWGQGTLVTVSS

SEQ ID NO: 4157 - protein, 120 aa, Artificial Sequence; identical to SEQ ID NO: 4156
  synthetic polypeptide

SEQ ID NO: 4158 - protein, 120 aa, Artificial Sequence; identical to SEQ ID NO: 4156
  synthetic polypeptide

SEQ ID NO: 4159 - protein, 120 aa, Artificial Sequence
  synthetic polypeptide
EVQLLESGGGLVQPGGSLRLSCAASGFTFDSYSMNWVRQAPGKGLEWVAGINYNSGYKSYADSVKGRFTISRDNSKNTLYLQMNSLRAEDTAVYYCARSATWHDTHLDYWGQGTLVTVSS

SEQ ID NO: 4160 - protein, 120 aa, Artificial Sequence; identical to SEQ ID NO: 4159
  synthetic polypeptide

SEQ ID NO: 4161 - protein, 120 aa, Artificial Sequence; identical to SEQ ID NO: 4159
  synthetic polypeptide

SEQ ID NO: 4162 - protein, 120 aa, Artificial Sequence; identical to SEQ ID NO: 4159
  synthetic polypeptide

SEQ ID NO: 4163 - protein, 120 aa, Artificial Sequence; identical to SEQ ID NO: 4159
  synthetic polypeptide

SEQ ID NO: 4164 - protein, 120 aa, Artificial Sequence
  synthetic polypeptide
EVQLLESGGGLVQPGGSLRLSCAASGFTFSSYSMNWVRQAPGKGLEWVAGINYNSGYKSYADSVKGRFTISRDNSKNTLYLQMNSLRAEDTAVYYCARSATWHDTHLDYWGQGTLVTVSS

SEQ ID NO: 4165 - protein, 120 aa, Artificial Sequence; identical to SEQ ID NO: 4164
  synthetic polypeptide

SEQ ID NO: 4166 - protein, 120 aa, Artificial Sequence; identical to SEQ ID NO: 4164
  synthetic polypeptide

SEQ ID NO: 4167 - protein, 120 aa, Artificial Sequence; identical to SEQ ID NO: 4164
  synthetic polypeptide

SEQ ID NO: 4168 - protein, 120 aa, Artificial Sequence
  synthetic polypeptide
EVQLLESGGGLVQPGGSLRLSCAASGFTFDSYSMNWVRQAPGKGLEWVAGINYNSGYTGYADSVKGRFTISRDNSKNTLYLQMNSLRAEDTAVYYCARSATWHDTHLDYWGQGTLVTVSS

SEQ ID NO: 4169 - protein, 120 aa, Artificial Sequence
  synthetic polypeptide
EVQLLESGGGLVQPGGSLRLSCAASGFTFSSYSMNWVRQAPGKGLEWVAGINYNSGYTGYADSVKGRFTISRDNSKNTLYLQMNSLRAEDTAVYYCARSATWHDTHLDYWGQGTLVTVSS

SEQ ID NO: 4170 - protein, 120 aa, Artificial Sequence
  synthetic polypeptide
EVQLLESGGGLVQPGGSLRLSCAASGFTFDSYSMNWVRQAPGKGLEWVAGINYNSGYTSYADSVKGRFTISRDNSKNTLYLQMNSLRAEDTAVYYCARSATWHDTHLDYWGQGTLVTVSS

SEQ ID NO: 4171 - protein, 120 aa, Artificial Sequence; identical to SEQ ID NO: 4170
  synthetic polypeptide

SEQ ID NO: 4172 - protein, 120 aa, Artificial Sequence
  synthetic polypeptide
EVQLLESGGGLVQPGGSLRLSCAASGFTFSSYGMHWVRQAPGKGLEWVAGINYNSGYTSYADSVKGRFTISRDNSKNTLYLQMNSLRAEDTAVYYCARSATWHDTHLDYWGQGTLVTVSS

SEQ ID NO: 4173 - protein, 120 aa, Artificial Sequence
  synthetic polypeptide
EVQLLESGGGLVQPGGSLRLSCAASGFTFSSYSMNWVRQAPGKGLEWVAGINYNSGYTSYADSVKGRFTISRDNSKNTLYLQMNSLRAEDTAVYYCARSATWHDTHLDYWGQGTLVTVSS

SEQ ID NO: 4174 - protein, 120 aa, Artificial Sequence
  synthetic polypeptide
EVQLLESGGGLVQPGGSLRLSCAASGFTFSSYGMNWVRQAPGKGLEWVANINYNGGYKGYADSVKGRFTISRDNSKNTLYLQMNSLRAEDTAVYYCARSATWHDTHLDYWGQGTLVTVSS

SEQ ID NO: 4175 - protein, 120 aa, Artificial Sequence
  synthetic polypeptide
EVQLLESGGGLVQPGGSLRLSCAASGFTFDSYSMNWVRQAPGKGLEWVANINYNGGYTGYADSVKGRFTISRDNSKNTLYLQMNSLRAEDTAVYYCARSATWHDTHLDYWGQGTLVTVSS

SEQ ID NO: 4176 - protein, 120 aa, Artificial Sequence; identical to SEQ ID NO: 4175
  synthetic polypeptide

SEQ ID NO: 4177 - protein, 120 aa, Artificial Sequence; identical to SEQ ID NO: 4175
  synthetic polypeptide

SEQ ID NO: 4178 - protein, 120 aa, Artificial Sequence
  synthetic polypeptide
EVQLLESGGGLVQPGGSLRLSCAASGFTFSDYSMNWVRQAPGKGLEWVANINYNGGYTGYADSVKGRFTISRDNSKNTLYLQMNSLRAEDTAVYYCARSATWHDTHLDYWGQGTLVTVSS

SEQ ID NO: 4179 - protein, 120 aa, Artificial Sequence
  synthetic polypeptide
EVQLLESGGGLVQPGGSLRLSCAASGFTFSSYSMNWVRQAPGKGLEWVANINYNGGYTGYADSVKGRFTISRDNSKNTLYLQMNSLRAEDTAVYYCARSATWHDTHLDYWGQGTLVTVSS

SEQ ID NO: 4180 - protein, 120 aa, Artificial Sequence
  synthetic polypeptide
EVQLLESGGGLVQPGGSLRLSCAASGFTFDDYGMNWVRQAPGKGLEWVANINYNGGYTSYADSVKGRFTISRDNSKNTLYLQMNSLRAEDTAVYYCARSATWHDTHLDYWGQGTLVTVSS

SEQ ID NO: 4181 - protein, 120 aa, Artificial Sequence
  synthetic polypeptide
EVQLLESGGGLVQPGGSLRLSCAASGFTFDSYGMHWVRQAPGKGLEWVANINYNGGYTSYADSVKGRFTISRDNSKNTLYLQMNSLRAEDTAVYYCARSATWHDTHLDYWGQGTLVTVSS

SEQ ID NO: 4182 - protein, 120 aa, Artificial Sequence; identical to SEQ ID NO: 4181
  synthetic polypeptide

SEQ ID NO: 4183 - protein, 120 aa, Artificial Sequence
  synthetic polypeptide
EVQLLESGGGLVQPGGSLRLSCAASGFTFDSYSMNWVRQAPGKGLEWVANINYNGGYTSYADSVKGRFTISRDNSKNTLYLQMNSLRAEDTAVYYCARSATWHDTHLDYWGQGTLVTVSS

SEQ ID NO: 4184 - protein, 120 aa, Artificial Sequence
  synthetic polypeptide
EVQLLESGGGLVQPGGSLRLSCAASGFTFDSYSMNWVRQAPGKGLEWVANINYNSGYKGYADSVKGRFTISRDNSKNTLYLQMNSLRAEDTAVYYCARSATWHDTHLDYWGQGTLVTVSS

SEQ ID NO: 4185 - protein, 120 aa, Artificial Sequence
  synthetic polypeptide
EVQLLESGGGLVQPGGSLRLSCAASGFTFSDYSMNWVRQAPGKGLEWVANINYNSGYKGYADSVKGRFTISRDNSKNTLYLQMNSLRAEDTAVYYCARSATWHDTHLDYWGQGTLVTVSS

SEQ ID NO: 4186 - protein, 120 aa, Artificial Sequence
  synthetic polypeptide
EVQLLESGGGLVQPGGSLRLSCAASGFTFSSYSMNWVRQAPGKGLEWVANINYNSGYKGYADSVKGRFTISRDNSKNTLYLQMNSLRAEDTAVYYCARSATWHDTHLDYWGQGTLVTVSS

SEQ ID NO: 4187 - protein, 120 aa, Artificial Sequence
  synthetic polypeptide
EVQLLESGGGLVQPGGSLRLSCAASGFTFDSYSMNWVRQAPGKGLEWVANINYNSGYTGYADSVKGRFTISRDNSKNTLYLQMNSLRAEDTAVYYCARSATWHDTHLDYWGQGTLVTVSS

SEQ ID NO: 4188 - protein, 120 aa, Artificial Sequence
  synthetic polypeptide
EVQLLESGGGLVQPGGSLRLSCAASGFTFSSYSMNWVRQAPGKGLEWVANINYNSGYTGYADSVKGRFTISRDNSKNTLYLQMNSLRAEDTAVYYCARSATWHDTHLDYWGQGTLVTVSS

SEQ ID NO: 4189 - protein, 120 aa, Artificial Sequence
  synthetic polypeptide
EVQLLESGGGLVQPGGSLRLSCAASGFTFSDYGMNWVRQAPGKGLEWVASINYNGGYTGYADSVKGRFTISRDNSKNTLYLQMNSLRAEDTAVYYCARSATWHDTHLDYWGQGTLVTVSS

SEQ ID NO: 4190 - protein, 120 aa, Artificial Sequence
  synthetic polypeptide
EVQLLESGGGLVQPGGSLRLSCAASGFTFSSYSMNWVRQAPGKGLEWVASINYNGGYTGYADSVKGRFTISRDNSKNTLYLQMNSLRAEDTAVYYCARSATWHDTHLDYWGQGTLVTVSS

SEQ ID NO: 4191 - protein, 120 aa, Artificial Sequence
  synthetic polypeptide
EVQLLESGGGLVQPGGSLRLSCAASGFTFDSYGMHWVRQAPGKGLEWVASINYNGGYTSYADSVKGRFTISRDNSKNTLYLQMNSLRAEDTAVYYCARSATWHDTHLDYWGQGTLVTVSS

SEQ ID NO: 4192 - protein, 120 aa, Artificial Sequence; identical to SEQ ID NO: 4191
  synthetic polypeptide

SEQ ID NO: 4193 - protein, 120 aa, Artificial Sequence
  synthetic polypeptide
EVQLLESGGGLVQPGGSLRLSCAASGFTFSDYGMHWVRQAPGKGLEWVASINYNGGYTSYADSVKGRFTISRDNSKNTLYLQMNSLRAEDTAVYYCARSATWHDTHLDYWGQGTLVTVSS

SEQ ID NO: 4194 - protein, 120 aa, Artificial Sequence
  synthetic polypeptide
EVQLLESGGGLVQPGGSLRLSCAASGFTFSSYGMHWVRQAPGKGLEWVASINYNGGYTSYADSVKGRFTISRDNSKNTLYLQMNSLRAEDTAVYYCARSATWHDTHLDYWGQGTLVTVSS

SEQ ID NO: 4195 - protein, 120 aa, Artificial Sequence
  synthetic polypeptide
EVQLLESGGGLVQPGGSLRLSCAASGFTFSSYGMNWVRQAPGKGLEWVASINYNGGYTSYADSVKGRFTISRDNSKNTLYLQMNSLRAEDTAVYYCARSATWHDTHLDYWGQGTLVTVSS

SEQ ID NO: 4196 - protein, 120 aa, Artificial Sequence
  synthetic polypeptide
EVQLLESGGGLVQPGGSLRLSCAASGFTFSSYSMNWVRQAPGKGLEWVASINYNGGYTSYADSVKGRFTISRDNSKNTLYLQMNSLRAEDTAVYYCARSATWHDTHLDYWGQGTLVTVSS

SEQ ID NO: 4197 - protein, 120 aa, Artificial Sequence
  synthetic polypeptide
EVQLLESGGGLVQPGGSLRLSCAASGFTFDSYSMNWVRQAPGKGLEWVASINYNSGYKGYADSVKGRFTISRDNSKNTLYLQMNSLRAEDTAVYYCARSATWHDTHLDYWGQGTLVTVSS

SEQ ID NO: 4198 - protein, 120 aa, Artificial Sequence
  synthetic polypeptide
EVQLLESGGGLVQPGGSLRLSCAASGFTFDDYSMNWVRQAPGKGLEWVASINYNSGYKSYADSVKGRFTISRDNSKNTLYLQMNSLRAEDTAVYYCARSATWHDTHLDYWGQGTLVTVSS

SEQ ID NO: 4199 - protein, 120 aa, Artificial Sequence
  synthetic polypeptide
EVQLLESGGGLVQPGGSLRLSCAASGFTFSSYSMNWVRQAPGKGLEWVASINYNSGYKSYADSVKGRFTISRDNSKNTLYLQMNSLRAEDTAVYYCARSATWHDTHLDYWGQGTLVTVSS

SEQ ID NO: 4200 - protein, 120 aa, Artificial Sequence; identical to SEQ ID NO: 4199
  synthetic polypeptide

SEQ ID NO: 4201 - protein, 120 aa, Artificial Sequence
  synthetic polypeptide
EVQLLESGGGLVQPGGSLRLSCAASGFTFSDYGMHWVRQAPGKGLEWVASINYNSGYTSYADSVKGRFTISRDNSKNTLYLQMNSLRAEDTAVYYCARSATWHDTHLDYWGQGTLVTVSS

SEQ ID NO: 4202 - protein, 120 aa, Artificial Sequence
  synthetic polypeptide
EVQLLESGGGLVQPGGSLRLSCAASGFTFSSYGMHWVRQAPGKGLEWVASINYNSGYTSYADSVKGRFTISRDNSKNTLYLQMNSLRAEDTAVYYCARSATWHDTHLDYWGQGTLVTVSS

SEQ ID NO: 4203 - protein, 120 aa, Artificial Sequence
  synthetic polypeptide
EVQLLESGGGLVQPGGSLRLSCAASGFTFSSYGMNWVRQAPGKGLEWVASINYNSGYTSYADSVKGRFTISRDNSKNTLYLQMNSLRAEDTAVYYCARSATWHDTHLDYWGQGTLVTVSS

SEQ ID NO: 4204 - protein, 120 aa, Artificial Sequence
  synthetic polypeptide
EVQLLESGGGLVQPGGSLRLSCAASGFTFDSYGMHWVRQAPGKGLEWVSGINYNGGYKGYADSVKGRFTISRDNSKNTLYLQMNSLRAEDTAVYYCARSATWHDTHLDYWGQGTLVTVSS

SEQ ID NO: 4205 - protein, 120 aa, Artificial Sequence
  synthetic polypeptide
EVQLLESGGGLVQPGGSLRLSCAASGFTFSDYSMNWVRQAPGKGLEWVSGINYNGGYKGYADSVKGRFTISRDNSKNTLYLQMNSLRAEDTAVYYCARSATWHDTHLDYWGQGTLVTVSS

SEQ ID NO: 4206 - protein, 120 aa, Artificial Sequence
  synthetic polypeptide
EVQLLESGGGLVQPGGSLRLSCAASGFTFDSYSMNWVRQAPGKGLEWVSGINYNGGYKSYADSVKGRFTISRDNSKNTLYLQMNSLRAEDTAVYYCARSATWHDTHLDYWGQGTLVTVSS

SEQ ID NO: 4207 - protein, 120 aa, Artificial Sequence; identical to SEQ ID NO: 4206
  synthetic polypeptide

SEQ ID NO: 4208 - protein, 120 aa, Artificial Sequence; identical to SEQ ID NO: 4206
  synthetic polypeptide

SEQ ID NO: 4209 - protein, 120 aa, Artificial Sequence
  synthetic polypeptide
EVQLLESGGGLVQPGGSLRLSCAASGFTFSDYGMNWVRQAPGKGLEWVSGINYNGGYKSYADSVKGRFTISRDNSKNTLYLQMNSLRAEDTAVYYCARSATWHDTHLDYWGQGTLVTVSS

SEQ ID NO: 4210 - protein, 120 aa, Artificial Sequence
  synthetic polypeptide
EVQLLESGGGLVQPGGSLRLSCAASGFTFSSYSMNWVRQAPGKGLEWVSGINYNGGYKSYADSVKGRFTISRDNSKNTLYLQMNSLRAEDTAVYYCARSATWHDTHLDYWGQGTLVTVSS

SEQ ID NO: 4211 - protein, 120 aa, Artificial Sequence
  synthetic polypeptide
EVQLLESGGGLVQPGGSLRLSCAASGFTFDSYSMNWVRQAPGKGLEWVSGINYNGGYTGYADSVKGRFTISRDNSKNTLYLQMNSLRAEDTAVYYCARSATWHDTHLDYWGQGTLVTVSS

SEQ ID NO: 4212 - protein, 120 aa, Artificial Sequence; identical to SEQ ID NO: 4211
  synthetic polypeptide

SEQ ID NO: 4213 - protein, 120 aa, Artificial Sequence; identical to SEQ ID NO: 4211
  synthetic polypeptide

SEQ ID NO: 4214 - protein, 120 aa, Artificial Sequence; identical to SEQ ID NO: 4211
  synthetic polypeptide

SEQ ID NO: 4215 - protein, 120 aa, Artificial Sequence
  synthetic polypeptide
EVQLLESGGGLVQPGGSLRLSCAASGFTFDSYSMNWVRQAPGKGLEWVSGINYNGGYTSYADSVKGRFTISRDNSKNTLYLQMNSLRAEDTAVYYCARSATWHDTHLDYWGQGTLVTVSS

SEQ ID NO: 4216 - protein, 120 aa, Artificial Sequence
  synthetic polypeptide
EVQLLESGGGLVQPGGSLRLSCAASGFTFSSYGMHWVRQAPGKGLEWVSGINYNGGYTSYADSVKGRFTISRDNSKNTLYLQMNSLRAEDTAVYYCARSATWHDTHLDYWGQGTLVTVSS

SEQ ID NO: 4217 - protein, 120 aa, Artificial Sequence
  synthetic polypeptide
EVQLLESGGGLVQPGGSLRLSCAASGFTFSSYGMNWVRQAPGKGLEWVSGINYNGGYTSYADSVKGRFTISRDNSKNTLYLQMNSLRAEDTAVYYCARSATWHDTHLDYWGQGTLVTVSS

SEQ ID NO: 4218 - protein, 120 aa, Artificial Sequence
  synthetic polypeptide
EVQLLESGGGLVQPGGSLRLSCAASGFTFDSYSMNWVRQAPGKGLEWVSGINYNSGYKGYADSVKGRFTISRDNSKNTLYLQMNSLRAEDTAVYYCARSATWHDTHLDYWGQGTLVTVSS

SEQ ID NO: 4219 - protein, 120 aa, Artificial Sequence
  synthetic polypeptide
EVQLLESGGGLVQPGGSLRLSCAASGFTFSDYSMNWVRQAPGKGLEWVSGINYNSGYKGYADSVKGRFTISRDNSKNTLYLQMNSLRAEDTAVYYCARSATWHDTHLDYWGQGTLVTVSS

SEQ ID NO: 4220 - protein, 120 aa, Artificial Sequence
  synthetic polypeptide
EVQLLESGGGLVQPGGSLRLSCAASGFTFSSYSMNWVRQAPGKGLEWVSGINYNSGYKGYADSVKGRFTISRDNSKNTLYLQMNSLRAEDTAVYYCARSATWHDTHLDYWGQGTLVTVSS

SEQ ID NO: 4221 - protein, 120 aa, Artificial Sequence; identical to SEQ ID NO: 4220
  synthetic polypeptide

SEQ ID NO: 4222 - protein, 120 aa, Artificial Sequence
  synthetic polypeptide
EVQLLESGGGLVQPGGSLRLSCAASGFTFDDYSMNWVRQAPGKGLEWVSGINYNSGYKSYADSVKGRFTISRDNSKNTLYLQMNSLRAEDTAVYYCARSATWHDTHLDYWGQGTLVTVSS

SEQ ID NO: 4223 - protein, 120 aa, Artificial Sequence
  synthetic polypeptide
EVQLLESGGGLVQPGGSLRLSCAASGFTFDSYSMNWVRQAPGKGLEWVSGINYNSGYKSYADSVKGRFTISRDNSKNTLYLQMNSLRAEDTAVYYCARSATWHDTHLDYWGQGTLVTVSS

SEQ ID NO: 4224 - protein, 120 aa, Artificial Sequence; identical to SEQ ID NO: 4223
  synthetic polypeptide

SEQ ID NO: 4225 - protein, 120 aa, Artificial Sequence
  synthetic polypeptide
EVQLLESGGGLVQPGGSLRLSCAASGFTFSDYGMNWVRQAPGKGLEWVSGINYNSGYKSYADSVKGRFTISRDNSKNTLYLQMNSLRAEDTAVYYCARSATWHDTHLDYWGQGTLVTVSS

SEQ ID NO: 4226 - protein, 120 aa, Artificial Sequence
  synthetic polypeptide
EVQLLESGGGLVQPGGSLRLSCAASGFTFSDYSMNWVRQAPGKGLEWVSGINYNSGYKSYADSVKGRFTISRDNSKNTLYLQMNSLRAEDTAVYYCARSATWHDTHLDYWGQGTLVTVSS

SEQ ID NO: 4227 - protein, 120 aa, Artificial Sequence
  synthetic polypeptide
EVQLLESGGGLVQPGGSLRLSCAASGFTFSSYSMNWVRQAPGKGLEWVSGINYNSGYKSYADSVKGRFTISRDNSKNTLYLQMNSLRAEDTAVYYCARSATWHDTHLDYWGQGTLVTVSS

SEQ ID NO: 4228 - protein, 120 aa, Artificial Sequence; identical to SEQ ID NO: 4227
  synthetic polypeptide

SEQ ID NO: 4229 - protein, 120 aa, Artificial Sequence; identical to SEQ ID NO: 4227
  synthetic polypeptide

SEQ ID NO: 4230 - protein, 120 aa, Artificial Sequence
  synthetic polypeptide
EVQLLESGGGLVQPGGSLRLSCAASGFTFDSYGMNWVRQAPGKGLEWVSGINYNSGYTSYADSVKGRFTISRDNSKNTLYLQMNSLRAEDTAVYYCARSATWHDTHLDYWGQGTLVTVSS

SEQ ID NO: 4231 - protein, 120 aa, Artificial Sequence
  synthetic polypeptide
EVQLLESGGGLVQPGGSLRLSCAASGFTFDSYSMNWVRQAPGKGLEWVSGINYNSGYTSYADSVKGRFTISRDNSKNTLYLQMNSLRAEDTAVYYCARSATWHDTHLDYWGQGTLVTVSS

SEQ ID NO: 4232 - protein, 120 aa, Artificial Sequence; identical to SEQ ID NO: 4231
  synthetic polypeptide

SEQ ID NO: 4233 - protein, 120 aa, Artificial Sequence; identical to SEQ ID NO: 4231
  synthetic polypeptide

SEQ ID NO: 4234 - protein, 120 aa, Artificial Sequence; identical to SEQ ID NO: 4231
  synthetic polypeptide

SEQ ID NO: 4235 - protein, 120 aa, Artificial Sequence
  synthetic polypeptide
EVQLLESGGGLVQPGGSLRLSCAASGFTFSDYSMNWVRQAPGKGLEWVSGINYNSGYTSYADSVKGRFTISRDNSKNTLYLQMNSLRAEDTAVYYCARSATWHDTHLDYWGQGTLVTVSS

SEQ ID NO: 4236 - protein, 120 aa, Artificial Sequence
  synthetic polypeptide
EVQLLESGGGLVQPGGSLRLSCAASGFTFSSYSMNWVRQAPGKGLEWVSGINYNSGYTSYADSVKGRFTISRDNSKNTLYLQMNSLRAEDTAVYYCARSATWHDTHLDYWGQGTLVTVSS

SEQ ID NO: 4237 - protein, 120 aa, Artificial Sequence
  synthetic polypeptide
EVQLLESGGGLVQPGGSLRLSCAASGFTFDSYGMNWVRQAPGKGLEWVSNINYNGGYKGYADSVKGRFTISRDNSKNTLYLQMNSLRAEDTAVYYCARSATWHDTHLDYWGQGTLVTVSS

SEQ ID NO: 4238 - protein, 120 aa, Artificial Sequence; identical to SEQ ID NO: 4237
  synthetic polypeptide

SEQ ID NO: 4239 - protein, 120 aa, Artificial Sequence
  synthetic polypeptide
EVQLLESGGGLVQPGGSLRLSCAASGFTFDSYGMNWVRQAPGKGLEWVSNINYNGGYKSYADSVKGRFTISRDNSKNTLYLQMNSLRAEDTAVYYCARSATWHDTHLDYWGQGTLVTVSS

SEQ ID NO: 4240 - protein, 120 aa, Artificial Sequence; identical to SEQ ID NO: 4239
  synthetic polypeptide

SEQ ID NO: 4241 - protein, 120 aa, Artificial Sequence
  synthetic polypeptide
EVQLLESGGGLVQPGGSLRLSCAASGFTFDSYSMNWVRQAPGKGLEWVSNINYNGGYKSYADSVKGRFTISRDNSKNTLYLQMNSLRAEDTAVYYCARSATWHDTHLDYWGQGTLVTVSS

SEQ ID NO: 4242 - protein, 120 aa, Artificial Sequence
  synthetic polypeptide
EVQLLESGGGLVQPGGSLRLSCAASGFTFDSYGMNWVRQAPGKGLEWVSNINYNGGYTGYADSVKGRFTISRDNSKNTLYLQMNSLRAEDTAVYYCARSATWHDTHLDYWGQGTLVTVSS

SEQ ID NO: 4243 - protein, 120 aa, Artificial Sequence; identical to SEQ ID NO: 4242
  synthetic polypeptide

SEQ ID NO: 4244 - protein, 120 aa, Artificial Sequence
  synthetic polypeptide
EVQLLESGGGLVQPGGSLRLSCAASGFTFDSYSMNWVRQAPGKGLEWVSNINYNGGYTGYADSVKGRFTISRDNSKNTLYLQMNSLRAEDTAVYYCARSATWHDTHLDYWGQGTLVTVSS

SEQ ID NO: 4245 - protein, 120 aa, Artificial Sequence; identical to SEQ ID NO: 4244
  synthetic polypeptide

SEQ ID NO: 4246 - protein, 120 aa, Artificial Sequence; identical to SEQ ID NO: 4244
  synthetic polypeptide

SEQ ID NO: 4247 - protein, 120 aa, Artificial Sequence
  synthetic polypeptide
EVQLLESGGGLVQPGGSLRLSCAASGFTFSDYGMNWVRQAPGKGLEWVSNINYNGGYTGYADSVKGRFTISRDNSKNTLYLQMNSLRAEDTAVYYCARSATWHDTHLDYWGQGTLVTVSS

SEQ ID NO: 4248 - protein, 120 aa, Artificial Sequence; identical to SEQ ID NO: 4247
  synthetic polypeptide

SEQ ID NO: 4249 - protein, 120 aa, Artificial Sequence
  synthetic polypeptide
EVQLLESGGGLVQPGGSLRLSCAASGFTFSSYSMNWVRQAPGKGLEWVSNINYNGGYTGYADSVKGRFTISRDNSKNTLYLQMNSLRAEDTAVYYCARSATWHDTHLDYWGQGTLVTVSS

SEQ ID NO: 4250 - protein, 120 aa, Artificial Sequence
  synthetic polypeptide
EVQLLESGGGLVQPGGSLRLSCAASGFTFDDYSMNWVRQAPGKGLEWVSNINYNGGYTSYADSVKGRFTISRDNSKNTLYLQMNSLRAEDTAVYYCARSATWHDTHLDYWGQGTLVTVSS

SEQ ID NO: 4251 - protein, 120 aa, Artificial Sequence
  synthetic polypeptide
EVQLLESGGGLVQPGGSLRLSCAASGFTFDSYSMNWVRQAPGKGLEWVSNINYNGGYTSYADSVKGRFTISRDNSKNTLYLQMNSLRAEDTAVYYCARSATWHDTHLDYWGQGTLVTVSS

SEQ ID NO: 4252 - protein, 120 aa, Artificial Sequence; identical to SEQ ID NO: 4251
  synthetic polypeptide

SEQ ID NO: 4253 - protein, 120 aa, Artificial Sequence; identical to SEQ ID NO: 4251
  synthetic polypeptide

SEQ ID NO: 4254 - protein, 120 aa, Artificial Sequence; identical to SEQ ID NO: 4251
  synthetic polypeptide

SEQ ID NO: 4255 - protein, 120 aa, Artificial Sequence
  synthetic polypeptide
EVQLLESGGGLVQPGGSLRLSCAASGFTFSSYSMNWVRQAPGKGLEWVSNINYNGGYTSYADSVKGRFTISRDNSKNTLYLQMNSLRAEDTAVYYCARSATWHDTHLDYWGQGTLVTVSS

SEQ ID NO: 4256 - protein, 120 aa, Artificial Sequence
  synthetic polypeptide
EVQLLESGGGLVQPGGSLRLSCAASGFTFDDYSMNWVRQAPGKGLEWVSNINYNSGYKGYADSVKGRFTISRDNSKNTLYLQMNSLRAEDTAVYYCARSATWHDTHLDYWGQGTLVTVSS

SEQ ID NO: 4257 - protein, 120 aa, Artificial Sequence
  synthetic polypeptide
EVQLLESGGGLVQPGGSLRLSCAASGFTFDSYSMNWVRQAPGKGLEWVSNINYNSGYKGYADSVKGRFTISRDNSKNTLYLQMNSLRAEDTAVYYCARSATWHDTHLDYWGQGTLVTVSS

SEQ ID NO: 4258 - protein, 120 aa, Artificial Sequence
  synthetic polypeptide
EVQLLESGGGLVQPGGSLRLSCAASGFTFSDYSMNWVRQAPGKGLEWVSNINYNSGYKGYADSVKGRFTISRDNSKNTLYLQMNSLRAEDTAVYYCARSATWHDTHLDYWGQGTLVTVSS

SEQ ID NO: 4259 - protein, 120 aa, Artificial Sequence
  synthetic polypeptide
EVQLLESGGGLVQPGGSLRLSCAASGFTFSSYSMNWVRQAPGKGLEWVSNINYNSGYKGYADSVKGRFTISRDNSKNTLYLQMNSLRAEDTAVYYCARSATWHDTHLDYWGQGTLVTVSS

SEQ ID NO: 4260 - protein, 120 aa, Artificial Sequence; identical to SEQ ID NO: 4259
  synthetic polypeptide

SEQ ID NO: 4261 - protein, 120 aa, Artificial Sequence
  synthetic polypeptide
EVQLLESGGGLVQPGGSLRLSCAASGFTFDSYGMNWVRQAPGKGLEWVSNINYNSGYTGYADSVKGRFTISRDNSKNTLYLQMNSLRAEDTAVYYCARSATWHDTHLDYWGQGTLVTVSS

SEQ ID NO: 4262 - protein, 120 aa, Artificial Sequence
  synthetic polypeptide
EVQLLESGGGLVQPGGSLRLSCAASGFTFSSYGMNWVRQAPGKGLEWVSNINYNSGYTGYADSVKGRFTISRDNSKNTLYLQMNSLRAEDTAVYYCARSATWHDTHLDYWGQGTLVTVSS

SEQ ID NO: 4263 - protein, 120 aa, Artificial Sequence
  synthetic polypeptide
EVQLLESGGGLVQPGGSLRLSCAASGFTFDSYSMNWVRQAPGKGLEWVSNINYNSGYTSYADSVKGRFTISRDNSKNTLYLQMNSLRAEDTAVYYCARSATWHDTHLDYWGQGTLVTVSS

SEQ ID NO: 4264 - protein, 120 aa, Artificial Sequence; identical to SEQ ID NO: 4263
  synthetic polypeptide

SEQ ID NO: 4265 - protein, 120 aa, Artificial Sequence
  synthetic polypeptide
EVQLLESGGGLVQPGGSLRLSCAASGFTFDDYGMNWVRQAPGKGLEWVSSINYNGGYKSYADSVKGRFTISRDNSKNTLYLQMNSLRAEDTAVYYCARSATWHDTHLDYWGQGTLVTVSS

SEQ ID NO: 4266 - protein, 120 aa, Artificial Sequence
  synthetic polypeptide
EVQLLESGGGLVQPGGSLRLSCAASGFTFSSYGMNWVRQAPGKGLEWVSSINYNGGYKSYADSVKGRFTISRDNSKNTLYLQMNSLRAEDTAVYYCARSATWHDTHLDYWGQGTLVTVSS

SEQ ID NO: 4267 - protein, 120 aa, Artificial Sequence
  synthetic polypeptide
EVQLLESGGGLVQPGGSLRLSCAASGFTFSDYGMNWVRQAPGKGLEWVSSINYNGGYTGYADSVKGRFTISRDNSKNTLYLQMNSLRAEDTAVYYCARSATWHDTHLDYWGQGTLVTVSS

SEQ ID NO: 4268 - protein, 120 aa, Artificial Sequence
  synthetic polypeptide
EVQLLESGGGLVQPGGSLRLSCAASGFTFDSYGMHWVRQAPGKGLEWVSSINYNGGYTSYADSVKGRFTISRDNSKNTLYLQMNSLRAEDTAVYYCARSATWHDTHLDYWGQGTLVTVSS

SEQ ID NO: 4269 - protein, 120 aa, Artificial Sequence
  synthetic polypeptide
EVQLLESGGGLVQPGGSLRLSCAASGFTFSDYGMNWVRQAPGKGLEWVSSINYNGGYTSYADSVKGRFTISRDNSKNTLYLQMNSLRAEDTAVYYCARSATWHDTHLDYWGQGTLVTVSS

SEQ ID NO: 4270 - protein, 120 aa, Artificial Sequence
  synthetic polypeptide
EVQLLESGGGLVQPGGSLRLSCAASGFTFSSYSMHWVRQAPGKGLEWVSSINYNGGYTSYADSVKGRFTISRDNSKNTLYLQMNSLRAEDTAVYYCARSATWHDTHLDYWGQGTLVTVSS

SEQ ID NO: 4271 - protein, 120 aa, Artificial Sequence
  synthetic polypeptide
EVQLLESGGGLVQPGGSLRLSCAASGFTFSSYSMNWVRQAPGKGLEWVSSINYNGGYTSYADSVKGRFTISRDNSKNTLYLQMNSLRAEDTAVYYCARSATWHDTHLDYWGQGTLVTVSS

SEQ ID NO: 4272 - protein, 120 aa, Artificial Sequence
  synthetic polypeptide
EVQLLESGGGLVQPGGSLRLSCAASGFTFDSYSMNWVRQAPGKGLEWVSSINYNSGYKGYADSVKGRFTISRDNSKNTLYLQMNSLRAEDTAVYYCARSATWHDTHLDYWGQGTLVTVSS

SEQ ID NO: 4273 - protein, 120 aa, Artificial Sequence
  synthetic polypeptide
EVQLLESGGGLVQPGGSLRLSCAASGFTFSDYSMNWVRQAPGKGLEWVSSINYNSGYKGYADSVKGRFTISRDNSKNTLYLQMNSLRAEDTAVYYCARSATWHDTHLDYWGQGTLVTVSS

SEQ ID NO: 4274 - protein, 120 aa, Artificial Sequence
  synthetic polypeptide
EVQLLESGGGLVQPGGSLRLSCAASGFTFSSYSMNWVRQAPGKGLEWVSSINYNSGYKGYADSVKGRFTISRDNSKNTLYLQMNSLRAEDTAVYYCARSATWHDTHLDYWGQGTLVTVSS

SEQ ID NO: 4275 - protein, 120 aa, Artificial Sequence
  synthetic polypeptide
EVQLLESGGGLVQPGGSLRLSCAASGFTFDDYGMNWVRQAPGKGLEWVSSINYNSGYKSYADSVKGRFTISRDNSKNTLYLQMNSLRAEDTAVYYCARSATWHDTHLDYWGQGTLVTVSS

SEQ ID NO: 4276 - protein, 120 aa, Artificial Sequence
  synthetic polypeptide
EVQLLESGGGLVQPGGSLRLSCAASGFTFSSYGMNWVRQAPGKGLEWVSSINYNSGYKSYADSVKGRFTISRDNSKNTLYLQMNSLRAEDTAVYYCARSATWHDTHLDYWGQGTLVTVSS

SEQ ID NO: 4277 - protein, 120 aa, Artificial Sequence
  synthetic polypeptide
EVQLLESGGGLVQPGGSLRLSCAASGFTFDSYSMNWVRQAPGKGLEWVSSINYNSGYTGYADSVKGRFTISRDNSKNTLYLQMNSLRAEDTAVYYCARSATWHDTHLDYWGQGTLVTVSS

SEQ ID NO: 4278 - protein, 120 aa, Artificial Sequence; identical to SEQ ID NO: 4277
  synthetic polypeptide

SEQ ID NO: 4279 - protein, 120 aa, Artificial Sequence
  synthetic polypeptide
EVQLLESGGGLVQPGGSLRLSCAASGFTFSSYSMNWVRQAPGKGLEWVSSINYNSGYTGYADSVKGRFTISRDNSKNTLYLQMNSLRAEDTAVYYCARSATWHDTHLDYWGQGTLVTVSS

SEQ ID NO: 4280 - protein, 120 aa, Artificial Sequence
  synthetic polypeptide
EVQLLESGGGLVQPGGSLRLSCAASGFTFSSYGMNWVRQAPGKGLEWVSSINYNSGYTSYADSVKGRFTISRDNSKNTLYLQMNSLRAEDTAVYYCARSATWHDTHLDYWGQGTLVTVSS

SEQ ID NO: 4281 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSYENPLTFGGGTKVEIK

SEQ ID NO: 4282 - protein, 107 aa, Artificial Sequence
  synthetic polypeptide
DIQMTQSPSSLSASVGDRVTITCRASQSIITYLNWYQQKPGKAPKLLIYAATSLASGVPSRFSGSGSGTDFTLTISSLQPEDFATYYCQQSDESPLTFGGGTKVEIK

SEQ ID NO: 4283 - protein, 107 aa, Artificial Sequence
  synthetic polypeptide
DIQMTQSPSSLSASVGDRVTITCRASQSIITYLNWYQQKPGKAPKLLIYAATSRASGVPSRFSGSGSGTDFTLTISSLQPEDFATYYCQQSYDSPLTFGGGTKVEIK

SEQ ID NO: 4284 - protein, 107 aa, Artificial Sequence; identical to SEQ ID NO: 91
  synthetic polypeptide

SEQ ID NO: 4285 - protein, 107 aa, Artificial Sequence; identical to SEQ ID NO: 91
  synthetic polypeptide

SEQ ID NO: 4286 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYSNPLTFGGGTKVEIK

SEQ ID NO: 4287 - protein, 107 aa, Artificial Sequence
  synthetic polypeptide
DIQMTQSPSSLSASVGDRVTITCRASQSILSYVNWYQQKPGKAPKLVIYATTSRASGVPSRFSGSGSGTDFTLTISSLQPEDFATYYCQQSYENPLTFGGGTKVEIK

SEQ ID NO: 4288 - protein, 107 aa, Artificial Sequence; identical to SEQ ID NO: 4287
  synthetic polypeptide

SEQ ID NO: 4289 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYNTPLTFGGGTKVEIK

SEQ ID NO: 4290 - protein, 107 aa, Artificial Sequence
  synthetic polypeptide
DIQMTQSPSSLSASVGDRVTITCRASQSIVTYLNWYQQKPGKAPKLLIYAATSLHSGVPSRFSGSGSGTDFTLTISSLQPEDFATYYCQQSDSLPLTFGGGTKVEIK

SEQ ID NO: 4291 - protein, 107 aa, Artificial Sequence; identical to SEQ ID NO: 2484
  synthetic polypeptide

SEQ ID NO: 4292 - protein, 107 aa, Artificial Sequence; identical to SEQ ID NO: 89
  synthetic polypeptide

SEQ ID NO: 4293 - protein, 107 aa, Artificial Sequence; identical to SEQ ID NO: 2446
  synthetic polypeptide

SEQ ID NO: 4294 - protein, 107 aa, Artificial Sequence
  synthetic polypeptide
DIQMTQSPSSLSASVGDRVTITCRASQSILSYLNWYQQKPGKAPKLVIYYVSNRASGVPSRFSGSGSGTDFTLTISSLQPEDFATYYCQQSYDNPLTFGGGTKVEIK

SEQ ID NO: 4295 - protein, 107 aa, Artificial Sequence; identical to SEQ ID NO: 4294
  synthetic polypeptide

SEQ ID NO: 4296 - protein, 107 aa, Artificial Sequence; identical to SEQ ID NO: 583
  synthetic polypeptide

SEQ ID NO: 4297 - protein, 107 aa, Artificial Sequence; identical to SEQ ID NO: 583
  synthetic polypeptide

SEQ ID NO: 4298 - protein, 107 aa, Artificial Sequence; identical to SEQ ID NO: 583
  synthetic polypeptide

SEQ ID NO: 4299 - protein, 107 aa, Artificial Sequence
  synthetic polypeptide
DIQMTQSPSSLSASVGDRVTITCRASQSILTYVNWYQQKPGKAPKLVIYAATSRHSGVPSRFSGSGSGTDFTLTISSLQPEDFATYYCQQSYDTPLTFGGGTKVEIK

SEQ ID NO: 4300 - protein, 107 aa, Artificial Sequence
  synthetic polypeptide
DIQMTQSPSSLSASVGDRVTITCRASQSIISYVNWYQQKPGKAPKLLIYAASSLQSGVPSRFSGSGSGTDFTLTISSLQPEDFATYYCQQSYSTPLTFGGGTKVEIK

SEQ ID NO: 4301 - protein, 107 aa, Artificial Sequence; identical to SEQ ID NO: 591
  synthetic polypeptide

SEQ ID NO: 4302 - protein, 107 aa, Artificial Sequence [sequence omitted]

SEQ ID NO: 4303 - protein, 107 aa, Artificial Sequence; identical to SEQ ID NO: 1372
  synthetic polypeptide

SEQ ID NO: 4304 - protein, 107 aa, Artificial Sequence
  synthetic polypeptide
DIQMTQSPSSLSASVGDRVTITCRASQSIITYLNWYQQKPGKAPKLLIYAASSLQSGVPSRFSGSGSGTDFTLTISSLQPEDFATYYCQQSYSTPLTFGGGTKVEIK

SEQ ID NO: 4305 - protein, 107 aa, Artificial Sequence [sequence omitted]

SEQ ID NO: 4306 - protein, 107 aa, Artificial Sequence
  synthetic polypeptide
DIQMTQSPSSLSASVGDRVTITCRASQSIVTYVNWYQQKPGKAPKLLIYAATSRASGVPSRFSGSGSGTDFTLTISSLQPEDFATYYCQQSYDTPLTFGGGTKVEIK

SEQ ID NO: 4307 - protein, 107 aa, Artificial Sequence; identical to SEQ ID NO: 1306
  synthetic polypeptide

SEQ ID NO: 4308 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYENPLTFGGGTKVEIK

SEQ ID NO: 4309 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYESPLTFGGGTKVEIK

SEQ ID NO: 4310 - protein, 107 aa, Artificial Sequence; identical to SEQ ID NO: 1313
  synthetic polypeptide

SEQ ID NO: 4311 - protein, 107 aa, Artificial Sequence
  synthetic polypeptide
DIQMTQSPSSLSASVGDRVTITCRASQSILSYVNWYQQKPGKAPKLVIYAATSRHSGVPSRFSGSGSGTDFTLTISSLQPEDFATYYCQQSYDTPLTFGGGTKVEIK

SEQ ID NO: 4312 - protein, 107 aa, Artificial Sequence
  synthetic polypeptide
DIQMTQSPSSLSASVGDRVTITCRASQSIISYVNWYQQKPGKAPKLLIYAATSRHSGVPSRFSGSGSGTDFTLTISSLQPEDFATYYCQQSYNLPLTFGGGTKVEIK

SEQ ID NO: 4313 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYNLPLTFGGGTKVEIK

SEQ ID NO: 4314 - protein, 107 aa, Artificial Sequence; identical to SEQ ID NO: 2572
  synthetic polypeptide

SEQ ID NO: 4315 - protein, 107 aa, Artificial Sequence; identical to SEQ ID NO: 2572
  synthetic polypeptide

SEQ ID NO: 4316 - protein, 107 aa, Artificial Sequence
  synthetic polypeptide
DIQMTQSPSSLSASVGDRVTITCRASQSILTYVNWYQQKPGKAPKLLIYAATSLHSGVPSRFSGSGSGTDFTLTISSLQPEDFATYYCQQSYNTPLTFGGGTKVEIK

SEQ ID NO: 4317 - protein, 107 aa, Artificial Sequence
  synthetic polypeptide
DIQMTQSPSSLSASVGDRVTITCRASQSILTYVNWYQQKPGKAPKLVIYATTSLASGVPSRFSGSGSGTDFTLTISSLQPEDFATYYCQQSYSTPLTFGGGTKVEIK

SEQ ID NO: 4318 - protein, 107 aa, Artificial Sequence
  synthetic polypeptide
DIQMTQSPSSLSASVGDRVTITCRASQSIISYVNWYQQKPGKAPKLLIYAATSLASGVPSRFSGSGSGTDFTLTISSLQPEDFATYYCQQSYDLPLTFGGGTKVEIK

SEQ ID NO: 4319 - protein, 107 aa, Artificial Sequence
  synthetic polypeptide
DIQMTQSPSSLSASVGDRVTITCRASQSILTYVNWYQQKPGKAPKLVIYAATSRASGVPSRFSGSGSGTDFTLTISSLQPEDFATYYCQQSYDNPLTFGGGTKVEIK

SEQ ID NO: 4320 - protein, 107 aa, Artificial Sequence
  synthetic polypeptide
DIQMTQSPSSLSASVGDRVTITCRASQSILSYLNWYQQKPGKAPKLLIYAATSLASGVPSRFSGSGSGTDFTLTISSLQPEDFATYYCQQSYELPLTFGGGTKVEIK

SEQ ID NO: 4321 - protein, 107 aa, Artificial Sequence; identical to SEQ ID NO: 99
  synthetic polypeptide

SEQ ID NO: 4322 - protein, 107 aa, Artificial Sequence; identical to SEQ ID NO: 1304
  synthetic polypeptide

SEQ ID NO: 4323 - protein, 107 aa, Artificial Sequence
  synthetic polypeptide
DIQMTQSPSSLSASVGDRVTITCRASQSISSYLNWYQQKPGKAPKLLIYAATSLASGVPSRFSGSGSGTDFTLTISSLQPEDFATYYCQQSYSNPLTFGGGTKVEIK

SEQ ID NO: 4324 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYNLPLTFGGGTKVEIK

SEQ ID NO: 4325 - protein, 107 aa, Artificial Sequence; identical to SEQ ID NO: 1305
  synthetic polypeptide

SEQ ID NO: 4326 - protein, 107 aa, Artificial Sequence; identical to SEQ ID NO: 1269
  synthetic polypeptide

SEQ ID NO: 4327 - protein, 107 aa, Artificial Sequence; identical to SEQ ID NO: 1248
  synthetic polypeptide

SEQ ID NO: 4328 - protein, 107 aa, Artificial Sequence
  synthetic polypeptide
DIQMTQSPSSLSASVGDRVTITCRASQSILRYLNWYQQKPGKAPKLLIYAATSLHSGVPSRFSGSGSGTDFTLTISSLQPEDFATYYCQQSYDNPLTFGGGTKVEIK

SEQ ID NO: 4329 - protein, 107 aa, Artificial Sequence; identical to SEQ ID NO: 4328
  synthetic polypeptide

SEQ ID NO: 4330 - protein, 107 aa, Artificial Sequence
  synthetic polypeptide
DIQMTQSPSSLSASVGDRVTITCRASQSIIRYLNWYQQKPGKAPKLVIYAATSRASGVPSRFSGSGSGTDFTLTISSLQPEDFATYYCQQSYDNPLTFGGGTKVEIK

SEQ ID NO: 4331 - protein, 107 aa, Artificial Sequence; identical to SEQ ID NO: 78
  synthetic polypeptide

SEQ ID NO: 4332 - protein, 107 aa, Artificial Sequence; identical to SEQ ID NO: 99
  synthetic polypeptide

SEQ ID NO: 4333 - protein, 107 aa, Artificial Sequence
  synthetic polypeptide
DIQMTQSPSSLSASVGDRVTITCRASQSILSYLNWYQQKPGKAPKLLIYATTSLASGVPSRFSGSGSGTDFTLTISSLQPEDFATYYCQQSYDNPLTFGGGTKVEIK

SEQ ID NO: 4334 - protein, 107 aa, Artificial Sequence; identical to SEQ ID NO: 1357
  synthetic polypeptide

SEQ ID NO: 4335 - protein, 107 aa, Artificial Sequence; identical to SEQ ID NO: 593
  synthetic polypeptide

SEQ ID NO: 4336 - protein, 107 aa, Artificial Sequence
  synthetic polypeptide
DIQMTQSPSSLSASVGDRVTITCRASQSILSYLNWYQQKPGKAPKLLIYAATSRHSGVPSRFSGSGSGTDFTLTISSLQPEDFATYYCQQSYENPLTFGGGTKVEIK

SEQ ID NO: 4337 - protein, 107 aa, Artificial Sequence; identical to SEQ ID NO: 100
  synthetic polypeptide

SEQ ID NO: 4338 - protein, 107 aa, Artificial Sequence; identical to SEQ ID NO: 4289
  synthetic polypeptide

SEQ ID NO: 4339 - protein, 107 aa, Artificial Sequence
  synthetic polypeptide
DIQMTQSPSSLSASVGDRVTITCRASQSILSYLNWYQQKPGKAPKLVIYAATSLASGVPSRFSGSGSGTDFTLTISSLQPEDFATYYCQQSYDLPLTFGGGTKVEIK

SEQ ID NO: 4340 - protein, 107 aa, Artificial Sequence
  synthetic polypeptide
DIQMTQSPSSLSASVGDRVTITCRASQSISTYVNWYQQKPGKAPKLLIYAVTSLASGVPSRFSGSGSGTDFTLTISSLQPEDFATYYCQQSYDSPLTFGGGTKVEIK

SEQ ID NO: 4341 - protein, 107 aa, Artificial Sequence
  synthetic polypeptide
DIQMTQSPSSLSASVGDRVTITCRASQSILTYLNWYQQKPGKAPKLVIYAVTSLASGVPSRFSGSGSGTDFTLTISSLQPEDFATYYCQQSYDSPLTFGGGTKVEIK

SEQ ID NO: 4342 - protein, 107 aa, Artificial Sequence [sequence omitted]

SEQ ID NO: 4343 - protein, 107 aa, Artificial Sequence
  synthetic polypeptide
DIQMTQSPSSLSASVGDRVTITCRASQSIVTYVNWYQQKPGKAPKLVIYAATSLASGVPSRFSGSGSGTDFTLTISSLQPEDFATYYCQQSYNLPLTFGGGTKVEIK

SEQ ID NO: 4344 - protein, 107 aa, Artificial Sequence; identical to SEQ ID NO: 1542
  synthetic polypeptide

SEQ ID NO: 4345 - protein, 107 aa, Artificial Sequence; identical to SEQ ID NO: 1542
  synthetic polypeptide

SEQ ID NO: 4346 - protein, 107 aa, Artificial Sequence; identical to SEQ ID NO: 584
  synthetic polypeptide

SEQ ID NO: 4347 - protein, 107 aa, Artificial Sequence; identical to SEQ ID NO: 65
  synthetic polypeptide

SEQ ID NO: 4348 - protein, 107 aa, Artificial Sequence; identical to SEQ ID NO: 1305
  synthetic polypeptide

SEQ ID NO: 4349 - protein, 107 aa, Artificial Sequence; identical to SEQ ID NO: 96
  synthetic polypeptide

SEQ ID NO: 4350 - protein, 107 aa, Artificial Sequence; identical to SEQ ID NO: 71
  synthetic polypeptide

SEQ ID NO: 4351 - protein, 107 aa, Artificial Sequence
  synthetic polypeptide
DIQMTQSPSSLSASVGDRVTITCRASQSIISYVNWYQQKPGKAPKLLIYAATSRHSGVPSRFSGSGSGTDFTLTISSLQPEDFATYYCQQSYELPLTFGGGTKVEIK

SEQ ID NO: 4352 - protein, 107 aa, Artificial Sequence
  synthetic polypeptide
DIQMTQSPSSLSASVGDRVTITCRASQSIISYVNWYQQKPGKAPKLLIYAATSRHSGVPSRFSGSGSGTDFTLTISSLQPEDFATYYCQQSYESPLTFGGGTKVEIK

SEQ ID NO: 4353 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSYENPLTFGGGTKVEIK

SEQ ID NO: 4354 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYSSPLTFGGGTKVEIK

SEQ ID NO: 4355 - protein, 107 aa, Artificial Sequence; identical to SEQ ID NO: 1209
  synthetic polypeptide

SEQ ID NO: 4356 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSYDSPLTFGGGTKVEIK

SEQ ID NO: 4357 - protein, 107 aa, Artificial Sequence
  synthetic polypeptide
DIQMTQSPSSLSASVGDRVTITCRASQSILTYLNWYQQKPGKAPKLLIYAATSLHSGVPSRFSGSGSGTDFTLTISSLQPEDFATYYCQQSYDLPLTFGGGTKVEIK

SEQ ID NO: 4358 - protein, 107 aa, Artificial Sequence
  synthetic polypeptide
DIQMTQSPSSLSASVGDRVTITCRASQSIVTYLNWYQQKPGKAPKLLIYAATSPASGVPSRFSGSGSGTDFTLTISSLQPEDFATYYCQQSYELPLTFGGGTKVEIK

SEQ ID NO: 4359 - protein, 107 aa, Artificial Sequence; identical to SEQ ID NO: 1305
  synthetic polypeptide

SEQ ID NO: 4360 - protein, 107 aa, Artificial Sequence; identical to SEQ ID NO: 1534
  synthetic polypeptide

SEQ ID NO: 4361 - protein, 107 aa, Artificial Sequence; identical to SEQ ID NO: 2381
  synthetic polypeptide

SEQ ID NO: 4362 - protein, 107 aa, Artificial Sequence
  synthetic polypeptide
DIQMTQSPSSLSASVGDRVTITCRASQSILTYLNWYQQKPGKAPKLLIYAATSLASGVPSRFSGSGSGTDFTLTISSLQPEDFATYYCQQSYSSPLTFGGGTKVEIK

SEQ ID NO: 4363 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSDELPLTFGGGTKVEIK

SEQ ID NO: 4364 - protein, 107 aa, Artificial Sequence; identical to SEQ ID NO: 83
  synthetic polypeptide

SEQ ID NO: 4365 - protein, 107 aa, Artificial Sequence
  synthetic polypeptide
DIQMTQSPSSLSASVGDRVTITCRASQSILSYVNWYQQKPGKAPKLLIYATTSLASGVPSRFSGSGSGTDFTLTISSLQPEDFATYYCQQSYDLPLTFGGGTKVEIK

SEQ ID NO: 4366 - protein, 107 aa, Artificial Sequence; identical to SEQ ID NO: 1350
  synthetic polypeptide

SEQ ID NO: 4367 - protein, 107 aa, Artificial Sequence
  synthetic polypeptide
DIQMTQSPSSLSASVGDRVTITCRASQSIVTYLNWYQQKPGKAPKLVIYAATSLASGVPSRFSGSGSGTDFTLTISSLQPEDFATYYCQQSYDLPLTFGGGTKVEIK

SEQ ID NO: 4368 - protein, 107 aa, Artificial Sequence; identical to SEQ ID NO: 4367
  synthetic polypeptide

SEQ ID NO: 4369 - protein, 107 aa, Artificial Sequence
  synthetic polypeptide
DIQMTQSPSSLSASVGDRVTITCRASQSIISYLNWYQQKPGKAPKLLIYAVTSLASGVPSRFSGSGSGTDFTLTISSLQPEDFATYYCQQSYENPLTFGGGTKVEIK

SEQ ID NO: 4370 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSYETPLTFGGGTKVEIK

SEQ ID NO: 4371 - protein, 107 aa, Artificial Sequence
  synthetic polypeptide
DIQMTQSPSSLSASVGDRVTITCRASQSILSYLNWYQQKPGKAPKLLIYAATSRASGVPSRFSGSGSGTDFTLTISSLQPEDFATYYCQQSYENPLTFGGGTKVEIK

SEQ ID NO: 4372 - protein, 107 aa, Artificial Sequence
  synthetic polypeptide
DIQMTQSPSSLSASVGDRVTITCRASQSILSYLNWYQQKPGKAPKLLIYAASSLQSGVPSRFSGSGSGTDFTLTISSLQPEDFATYYCQQSYENPLTFGGGTKVEIK

SEQ ID NO: 4373 - protein, 107 aa, Artificial Sequence
  synthetic polypeptide
DIQMTQSPSSLSASVGDRVTITCRASQSIVRYLNWYQQKPGKAPKLLIYAASSLQSGVPSRFSGSGSGTDFTLTISSLQPEDFATYYCQQSYSTPLTFGGGTKVEIK

SEQ ID NO: 4374 - protein, 107 aa, Artificial Sequence; identical to SEQ ID NO: 1262
  synthetic polypeptide

SEQ ID NO: 4375 - protein, 107 aa, Artificial Sequence
  synthetic polypeptide
DIQMTQSPSSLSASVGDRVTITCRASQSILTYVNWYQQKPGKAPKLLIYAASSLQSGVPSRFSGSGSGTDFTLTISSLQPEDFATYYCQQSYDNPLTFGGGTKVEIK

SEQ ID NO: 4376 - protein, 107 aa, Artificial Sequence
  synthetic polypeptide
DIQMTQSPSSLSASVGDRVTITCRASQSILTYVNWYQQKPGKAPKLLIYATTSLASGVPSRFSGSGSGTDFTLTISSLQPEDFATYYCQQSYDSPLTFGGGTKVEIK

SEQ ID NO: 4377 - protein, 107 aa, Artificial Sequence
  synthetic polypeptide
DIQMTQSPSSLSASVGDRVTITCRASQSILSYLNWYQQKPGKAPKLVIYAATSRASGVPSRFSGSGSGTDFTLTISSLQPEDFATYYCQQSYNLPLTFGGGTKVEIK

SEQ ID NO: 4378 - protein, 107 aa, Artificial Sequence; identical to SEQ ID NO: 89
  synthetic polypeptide

SEQ ID NO: 4379 - protein, 107 aa, Artificial Sequence; identical to SEQ ID NO: 1343
  synthetic polypeptide

SEQ ID NO: 4380 - protein, 107 aa, Artificial Sequence
  synthetic polypeptide
DIQMTQSPSSLSASVGDRVTITCRASQSIVSYVNWYQQKPGKAPKLVIYAATSRASGVPSRFSGSGSGTDFTLTISSLQPEDFATYYCQQSYDLPLTFGGGTKVEIK

SEQ ID NO: 4381 - protein, 107 aa, Artificial Sequence; identical to SEQ ID NO: 1238
  synthetic polypeptide

SEQ ID NO: 4382 - protein, 107 aa, Artificial Sequence
  synthetic polypeptide
DIQMTQSPSSLSASVGDRVTITCRASQSILSYLNWYQQKPGKAPKLLIYAATSLHSGVPSRFSGSGSGTDFTLTISSLQPEDFATYYCQQSYENPLTFGGGTKVEIK

SEQ ID NO: 4383 - protein, 107 aa, Artificial Sequence; identical to SEQ ID NO: 1207
  synthetic polypeptide

SEQ ID NO: 4384 - protein, 107 aa, Artificial Sequence
  synthetic polypeptide
  misc_feature (93)..(93): Xaa can be any naturally occurring amino acid
DIQMTQSPSSLSASVGDRVTITCRASQSILTYVNWYQQKPGKAPKLVIYAAPSLASGVPSRFSGSGSGTDFTLTISSLQPEDFATYYCQQSYXTPLTFGGGTKVEIK

SEQ ID NO: 4385 - protein, 107 aa, Artificial Sequence
  synthetic polypeptide
DIQMTQSPSSLSASVGDRVTITCRASQSILSYVNWYQQKPGKAPKLVIYATTSLASGVPSRFSGSGSGTDFTLTISSLQPEDFATYYCQQSYNSPLTFGGGTKVEIK

SEQ ID NO: 4386 - protein, 107 aa, Artificial Sequence
  synthetic polypeptide
DIQMTQSPSSLSASVGDRVTITCRASQSIISYVNWYQQKPGKAPKLLIYAATSRHSGVPSRFSGSGSGTDFTLTISSLQPEDFATYYCQQSYDNPLTFGGGTKVEIK

SEQ ID NO: 4387 - protein, 107 aa, Artificial Sequence; identical to SEQ ID NO: 90
  synthetic polypeptide

SEQ ID NO: 4388 - protein, 107 aa, Artificial Sequence; identical to SEQ ID NO: 1291
  synthetic polypeptide

SEQ ID NO: 4389 - protein, 107 aa, Artificial Sequence
  synthetic polypeptide
DIQMTQSPSSLSASVGDRVTITCRASQSILSYVNWYQQKPGKAPKLLIYAATSRHSGVPSRFSGSGSGTDFTLTISSLQPEDFATYYCQQSYDLPLTFGGGTKVEIK

SEQ ID NO: 4390 - protein, 107 aa, Artificial Sequence
  synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYNSPLTFGGGTKVEIK

SEQ ID NO: 4391 - protein, 107 aa, Artificial Sequence
  synthetic polypeptide
DIQMTQSPSSLSASVGDRVTITCRASQSILSYVNWYQQKPGKAPKLVIYAVTSRASGVPSRFSGSGSGTDFTLTISSLQPEDFATYYCQQSYELPLTFGGGTKVEIK

SEQ ID NO: 4392 - protein, 107 aa, Artificial Sequence; identical to SEQ ID NO: 547
  synthetic polypeptide

SEQ ID NO: 4393 - protein, 107 aa, Artificial Sequence; identical to SEQ ID NO: 1510
  synthetic polypeptide

SEQ ID NO: 4394 - protein, 107 aa, Artificial Sequence; identical to SEQ ID NO: 4309
  synthetic polypeptide

SEQ ID NO: 4395 - protein, 107 aa, Artificial Sequence
  synthetic polypeptide
DIQMTQSPSSLSASVGDRVTITCRASQSILSYVNWYQQKPGKAPKLVIYAATSRASGVPSRFSGSGSGTDFTLTISSLQPEDFATYYCQQSYSLPLTFGGGTKVEIK

SEQ ID NO: 4396 - protein, 107 aa, Artificial Sequence; identical to SEQ ID NO: 1382
  synthetic polypeptide

SEQ ID NO: 4397 - protein, 107 aa, Artificial Sequence; identical to SEQ ID NO: 4343
  synthetic polypeptide

SEQ ID NO: 4398 - protein, 107 aa, Artificial Sequence
  synthetic polypeptide
DIQMTQSPSSLSASVGDRVTITCRASQSILSYLNWYQQKPGKAPKLLIYAVTSRASGVPSRFSGSGSGTDFTLTISSLQPEDFATYYCQQSYNNPLTFGGGTKVEIK

SEQ ID NO: 4399 - protein, 107 aa, Artificial Sequence
  synthetic polypeptide
DIQMTQSPSSLSASVGDRVTITCRASQSIVSYVNWYQQKPGKAPKLLIYAVTSRASGVPSRFSGSGSGTDFTLTISSLQPEDFATYYCQQSYESPLTFGGGTKVEIK

SEQ ID NO: 4400 - protein, 107 aa, Artificial Sequence; identical to SEQ ID NO: 2579
  synthetic polypeptide

SEQ ID NO: 4401 - protein, 107 aa, Artificial Sequence
  synthetic polypeptide
DIQMTQSPSSLSASVGDRVTITCRASQSIISYVNWYQQKPGKAPKLVIYAATSLASGVPSRFSGSGSGTDFTLTISSLQPEDFATYYCQQSYDLPLTFGGGTKVEIK

SEQ ID NO: 4402 - protein, 107 aa, Artificial Sequence
  synthetic polypeptide
DIQMTQSPSSLSASVGDRVTITCRASQSILTYLNWYQQKPGKAPKLLIYAASSLQSGVPSRFSGSGSGTDFTLTISSLQPEDFATYYCQQSYDTPLTFGGGTKVEIK

SEQ ID NO: 4403 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSYENPLTFGGGTKVEIK

SEQ ID NO: 4404 - protein, 107 aa, Artificial Sequence
  synthetic polypeptide
DIQMTQSPSSLSASVGDRVTITCRASQSIVSYVNWYQQKPGKAPKLVIYAATSLASGVPSRFSGSGSGTDFTLTISSLQPEDFATYYCQQSYSTPLTFGGGTKVEIK

SEQ ID NO: 4405 - protein, 107 aa, Artificial Sequence
  synthetic polypeptide
DIQMTQSPSSLSASVGDRVTITCRASQSILTYLNWYQQKPGKAPKLVIYAATSLASGVPSRFSGSGSGTDFTLTISSLQPEDFATYYCQQSDETPLTFGGGTKVEIK

SEQ ID NO: 4406 - protein, 107 aa, Artificial Sequence
  synthetic polypeptide
DIQMTQSPSSLSASVGDRVTITCRASQSILTYLNWYQQKPGKAPKLLIYAATSRHSGVPSRFSGSGSGTDFTLTISSLQPEDFATYYCQQSDSLPLTFGGGTKVEIK

SEQ ID NO: 4407 - protein, 107 aa, Artificial Sequence; identical to SEQ ID NO: 4371
  synthetic polypeptide

SEQ ID NO: 4408 - protein, 107 aa, Artificial Sequence
  synthetic polypeptide
DIQMTQSPSSLSASVGDRVTITCRASQSIITYVNWYQQKPGKAPKLLIYAATSLASGVPSRFSGSGSGTDFTLTISSLQPEDFATYYCQQSYNLPLTFGGGTKVEIK

SEQ ID NO: 4409 - protein, 107 aa, Artificial Sequence
  synthetic polypeptide
DIQMTQSPSSLSASVGDRVTITCRASQSILTYLNWYQQKPGKAPKLVIYAATSRHSGVPSRFSGSGSGTDFTLTISSLQPEDFATYYCQQSYSNPLTFGGGTKVEIK

SEQ ID NO: 4410 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSNNLPLTFGGGTKVEIK

SEQ ID NO: 4411 - protein, 107 aa, Artificial Sequence; identical to SEQ ID NO: 595
  synthetic polypeptide

SEQ ID NO: 4412 - protein, 107 aa, Artificial Sequence
  synthetic polypeptide
DIQMTQSPSSLSASVGDRVTITCRASQSIVSYLNWYQQKPGKAPKLLIYAATSRASGVPSRFSGSGSGTDFTLTISSLQPEDFATYYCQQSYSTPLTFGGGTKVEIK

SEQ ID NO: 4413 - protein, 107 aa, Artificial Sequence
  synthetic polypeptide
DIQMTQSPSSLSASVGDRVTITCRASQSILTYVNWYQQKPGKAPKLLIYAATSLHSGVPSRFSGSGSGTDFTLTISSLQPEDFATYYCQQSDERPLTFGGGTKVEIK

SEQ ID NO: 4414 - protein, 107 aa, Artificial Sequence; identical to SEQ ID NO: 67
  synthetic polypeptide

SEQ ID NO: 4415 - protein, 107 aa, Artificial Sequence
  synthetic polypeptide
DIQMTQSPSSLSASVGDRVTITCRASQSIVTYLNWYQQKPGKAPKLLIYAATSRASGVPSRFSGSGSGTDFTLTISSLQPEDFATYYCQQSYDLPLTFGGGTKVEIK

SEQ ID NO: 4416 - protein, 107 aa, Artificial Sequence; identical to SEQ ID NO: 1534
  synthetic polypeptide

SEQ ID NO: 4417 - protein, 107 aa, Artificial Sequence; identical to SEQ ID NO: 4353
  synthetic polypeptide

SEQ ID NO: 4418 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSDNLPLTFGGGTKVEIK

SEQ ID NO: 4419 - protein, 107 aa, Artificial Sequence
  synthetic polypeptide
DIQMTQSPSSLSASVGDRVTITCRASQSIVTYVNWYQQKPGKAPKLLIYAATSRASGVPSRFSGSGSGTDFTLTISSLQPEDFATYYCQQSYENPLTFGGGTKVEIK

SEQ ID NO: 4420 - protein, 107 aa, Artificial Sequence
  synthetic polypeptide
DIQMTQSPSSLSASVGDRVTITCRASQSIISYLNWYQQKPGKAPKLLIYAATSRASGVPSRFSGSGSGTDFTLTISSLQPEDFATYYCQQSDELPLTFGGGTKVEIK

SEQ ID NO: 4421 - protein, 107 aa, Artificial Sequence; identical to SEQ ID NO: 1542
  synthetic polypeptide

SEQ ID NO: 4422 - protein, 107 aa, Artificial Sequence; identical to SEQ ID NO: 2572
  synthetic polypeptide

SEQ ID NO: 4423 - protein, 107 aa, Artificial Sequence
  synthetic polypeptide
DIQMTQSPSSLSASVGDRVTITCRASQSILTYVNWYQQKPGKAPKLLIYAATSRASGVPSRFSGSGSGTDFTLTISSLQPEDFATYYCQQSYSLPLTFGGGTKVEIK

SEQ ID NO: 4424 - protein, 107 aa, Artificial Sequence; identical to SEQ ID NO: 2572
  synthetic polypeptide

SEQ ID NO: 4425 - protein, 107 aa, Artificial Sequence [sequence omitted]

SEQ ID NO: 4426 - protein, 107 aa, Artificial Sequence; identical to SEQ ID NO: 2544
  synthetic polypeptide

SEQ ID NO: 4427 - protein, 107 aa, Artificial Sequence
  synthetic polypeptide
DIQMTQSPSSLSASVGDRVTITCRASQSIVTYLNWYQQKPGKAPKLVIYAVTSLHSGVPSRFSGSGSGTDFTLTISSLQPEDFATYYCQQSYELPLTFGGGTKVEIK

SEQ ID NO: 4428 - protein, 107 aa, Artificial Sequence; identical to SEQ ID NO: 2576
  synthetic polypeptide

SEQ ID NO: 4429 - protein, 107 aa, Artificial Sequence; identical to SEQ ID NO: 103
  synthetic polypeptide

SEQ ID NO: 4430 - protein, 107 aa, Artificial Sequence; identical to SEQ ID NO: 1207
  synthetic polypeptide

SEQ ID NO: 4431 - protein, 107 aa, Artificial Sequence; identical to SEQ ID NO: 1518
  synthetic polypeptide

SEQ ID NO: 4432 - protein, 107 aa, Artificial Sequence
  synthetic polypeptide
DIQMTQSPSSLSASVGDRVTITCRASQSIVTYLNWYQQKPGKAPKLLIYAATSLASGVPSRFSGSGSGTDFTLTISSLQPEDFATYYCQQSYDLPLTFGGGTKVEIK

SEQ ID NO: 4433 - protein, 107 aa, Artificial Sequence
  synthetic polypeptide
DIQMTQSPSSLSASVGDRVTITCRASQSILTYVNWYQQKPGKAPKLLIYATTSRHSGVPSRFSGSGSGTDFTLTISSLQPEDFATYYCQQSYNLPLTFGGGTKVEIK

SEQ ID NO: 4434 - protein, 107 aa, Artificial Sequence
  synthetic polypeptide
DIQMTQSPSSLSASVGDRVTITCRASQSILTYVNWYQQKPGKAPKLVIYAATSLASGVPSRFSGSGSGTDFTLTISSLQPEDFATYYCQQSYNSPLTFGGGTKVEIK

SEQ ID NO: 4435 - protein, 107 aa, Artificial Sequence
  synthetic polypeptide
DIQMTQSPSSLSASVGDRVTITCRASQSIVTYLNWYQQKPGKAPKLVIYAATSRHSGVPSRFSGSGSGTDFTLTISSLQPEDFATYYCQQSYDTPLTFGGGTKVEIK

SEQ ID NO: 4436 - protein, 107 aa, Artificial Sequence; identical to SEQ ID NO: 2579
  synthetic polypeptide

SEQ ID NO: 4437 - protein, 107 aa, Artificial Sequence
  synthetic polypeptide
DIQMTQSPSSLSASVGDRVTITCRASQSIVSYVNWYQQKPGKAPKLLIYAATSRHSGVPSRFSGSGSGTDFTLTISSLQPEDFATYYCQQSYDTPLTFGGGTKVEIK

SEQ ID NO: 4438 - protein, 107 aa, Artificial Sequence
  synthetic polypeptide
DIQMTQSPSSLSASVGDRVTITCRASQSISTYLNWYQQKPGKAPKLLIYAATSLASGVPSRFSGSGSGTDFTLTISSLQPEDFATYYCQQSYSNPLTFGGGTKVEIK

SEQ ID NO: 4439 - protein, 107 aa, Artificial Sequence; identical to SEQ ID NO: 1506
  synthetic polypeptide

SEQ ID NO: 4440 - protein, 107 aa, Artificial Sequence
  synthetic polypeptide
DIQMTQSPSSLSASVGDRVTITCRASQSILTYVNWYQQKPGKAPKLLIYAATSRHSGVPSRFSGSGSGTDFTLTISSLQPEDFATYYCQQSDNNPLTFGGGTKVEIK

SEQ ID NO: 4441 - protein, 107 aa, Artificial Sequence; identical to SEQ ID NO: 1287
  synthetic polypeptide

SEQ ID NO: 4442 - protein, 107 aa, Artificial Sequence; identical to SEQ ID NO: 590
  synthetic polypeptide

SEQ ID NO: 4443 - protein, 107 aa, Artificial Sequence
  synthetic polypeptide
DIQMTQSPSSLSASVGDRVTITCRASQSIVSYVNWYQQKPGKAPKLVIYAVTSLASGVPSRFSGSGSGTDFTLTISSLQPEDFATYYCQQSYETPLTFGGGTKVEIK

SEQ ID NO: 4444 - protein, 107 aa, Artificial Sequence; identical to SEQ ID NO: 2559
  synthetic polypeptide

SEQ ID NO: 4445 - protein, 107 aa, Artificial Sequence [sequence omitted]

SEQ ID NO: 4446 - protein, 107 aa, Artificial Sequence
  synthetic polypeptide
DIQMTQSPSSLSASVGDRVTITCRASQSIVTYLNWYQQKPGKAPKLVIYAATSRASGVPSRFSGSGSGTDFTLTISSLQPEDFATYYCQQSYDLPLTFGGGTKVEIK

SEQ ID NO: 4447 - protein, 107 aa, Artificial Sequence [sequence omitted]

SEQ ID NO: 4448 - protein, 107 aa, Artificial Sequence
  synthetic polypeptide
DIQMTQSPSSLSASVGDRVTITCRASQSIVSYLNWYQQKPGKAPKLVIYAATSRASGVPSRFSGSGSGTDFTLTISSLQPEDFATYYCQQSYDNPLTFGGGTKVEIK

SEQ ID NO: 4449 - protein, 107 aa, Artificial Sequence; identical to SEQ ID NO: 2401
  synthetic polypeptide

SEQ ID NO: 4450 - protein, 6 aa, Artificial Sequence
  synthetic polypeptide
SSYSMN

SEQ ID NO: 4451 - protein, 6 aa, Artificial Sequence
  synthetic polypeptide
SSYSMN

SEQ ID NO: 4452 - protein, 6 aa, Artificial Sequence
  synthetic polypeptide
DSYGMN

SEQ ID NO: 4453 - protein, 6 aa, Artificial Sequence
  synthetic polypeptide
SSYGMN

SEQ ID NO: 4454 - protein, 6 aa, Artificial Sequence
  synthetic polypeptide
DSYGMN

SEQ ID NO: 4455 - protein, 6 aa, Artificial Sequence
  synthetic polypeptide
SSYGMN

SEQ ID NO: 4456 - protein, 6 aa, Artificial Sequence
  synthetic polypeptide
SSYSMN

SEQ ID NO: 4457 - protein, 6 aa, Artificial Sequence
  synthetic polypeptide
SSYSMN

SEQ ID NO: 4458 - protein, 6 aa, Artificial Sequence
  synthetic polypeptide
DSYGMN

SEQ ID NO: 4459 - protein, 6 aa, Artificial Sequence
  synthetic polypeptide
SSYSMN

SEQ ID NO: 4460 - protein, 6 aa, Artificial Sequence
  synthetic polypeptide
SSYGMN

SEQ ID NO: 4461 - protein, 6 aa, Artificial Sequence
  synthetic polypeptide
SDYGMN

SEQ ID NO: 4462 - protein, 6 aa, Artificial Sequence
  synthetic polypeptide
DSYGMN

SEQ ID NO: 4463 - protein, 6 aa, Artificial Sequence
  synthetic polypeptide
DSYSMN

SEQ ID NO: 4464 - protein, 6 aa, Artificial Sequence
  synthetic polypeptide
DSYSMN

SEQ ID NO: 4465 - protein, 6 aa, Artificial Sequence
  synthetic polypeptide
SSYSMN

SEQ ID NO: 4466 - protein, 6 aa, Artificial Sequence
  synthetic polypeptide
SSYSMN

SEQ ID NO: 4467 - protein, 6 aa, Artificial Sequence
  synthetic polypeptide
DSYGMN

SEQ ID NO: 4468 - protein, 6 aa, Artificial Sequence
  synthetic polypeptide
DSYSMN

SEQ ID NO: 4469 - protein, 6 aa, Artificial Sequence
  synthetic polypeptide
DDYSMN

SEQ ID NO: 4470 - protein, 6 aa, Artificial Sequence
  synthetic polypeptide
DSYSMN

SEQ ID NO: 4471 - protein, 6 aa, Artificial Sequence
  synthetic polypeptide
DSYSMN

SEQ ID NO: 4472 - protein, 6 aa, Artificial Sequence
  synthetic polypeptide
SSYSMN

SEQ ID NO: 4473 - protein, 6 aa, Artificial Sequence
  synthetic polypeptide
DSYSMN

SEQ ID NO: 4474 - protein, 6 aa, Artificial Sequence
  synthetic polypeptide
DSYSMN

SEQ ID NO: 4475 - protein, 6 aa, Artificial Sequence
  synthetic polypeptide
SSYGMN

SEQ ID NO: 4476 - protein, 6 aa, Artificial Sequence
  synthetic polypeptide
SSYSMN

SEQ ID NO: 4477 - protein, 6 aa, Artificial Sequence
  synthetic polypeptide
SSYSMN

SEQ ID NO: 4478 - protein, 6 aa, Artificial Sequence
  synthetic polypeptide
SSYSMN

SEQ ID NO: 4479 - protein, 6 aa, Artificial Sequence
  synthetic polypeptide
SSYSMN

SEQ ID NO: 4480 - protein, 6 aa, Artificial Sequence
  synthetic polypeptide
DSYGMN

SEQ ID NO: 4481 - protein, 6 aa, Artificial Sequence
  synthetic polypeptide
DSYSMN

SEQ ID NO: 4482 - protein, 6 aa, Artificial Sequence
  synthetic polypeptide
DSYSMN

SEQ ID NO: 4483 - protein, 6 aa, Artificial Sequence
  synthetic polypeptide
DSYSMN

SEQ ID NO: 4484 - protein, 6 aa, Artificial Sequence
  synthetic polypeptide
DSYSMN

SEQ ID NO: 4485 - protein, 6 aa, Artificial Sequence
  synthetic polypeptide
DSYSMN

SEQ ID NO: 4486 - protein, 6 aa, Artificial Sequence
  synthetic polypeptide
SDYGMN

SEQ ID NO: 4487 - protein, 6 aa, Artificial Sequence
  synthetic polypeptide
SSYGMH

SEQ ID NO: 4488 - protein, 6 aa, Artificial Sequence
  synthetic polypeptide
SSYSMN

SEQ ID NO: 4489 - protein, 6 aa, Artificial Sequence
  synthetic polypeptide
SSYSMN

SEQ ID NO: 4490 - protein, 6 aa, Artificial Sequence
  synthetic polypeptide
DDYSMN

SEQ ID NO: 4491 - protein, 6 aa, Artificial Sequence
  synthetic polypeptide
DSYSMN

SEQ ID NO: 4492 - protein, 6 aa, Artificial Sequence
  synthetic polypeptide
DSYSMN

SEQ ID NO: 4493 - protein, 6 aa, Artificial Sequence
  synthetic polypeptide
SSYGMN

SEQ ID NO: 4494 - protein, 6 aa, Artificial Sequence
  synthetic polypeptide
SSYSMN

SEQ ID NO: 4495 - protein, 6 aa, Artificial Sequence
  synthetic polypeptide
SSYSMN

SEQ ID NO: 4496 - protein, 6 aa, Artificial Sequence
  synthetic polypeptide
SSYSMN

SEQ ID NO: 4497 - protein, 6 aa, Artificial Sequence
  synthetic polypeptide
DSYSMN

SEQ ID NO: 4498 - protein, 6 aa, Artificial Sequence
  synthetic polypeptide
DSYSMN

SEQ ID NO: 4499 - protein, 6 aa, Artificial Sequence
  synthetic polypeptide
DSYSMN

SEQ ID NO: 4500 - protein, 6 aa, Artificial Sequence
  synthetic polypeptide
DSYSMN

SEQ ID NO: 4501 - protein, 6 aa, Artificial Sequence
  synthetic polypeptide
DSYSMN

SEQ ID NO: 4502 - protein, 6 aa, Artificial Sequence
  synthetic polypeptide
SSYSMN

SEQ ID NO: 4503 - protein, 6 aa, Artificial Sequence
  synthetic polypeptide
SSYSMN

SEQ ID NO: 4504 - protein, 6 aa, Artificial Sequence
  synthetic polypeptide
SSYSMN

SEQ ID NO: 4505 - protein, 6 aa, Artificial Sequence
  synthetic polypeptide
SSYSMN

SEQ ID NO: 4506 - protein, 6 aa, Artificial Sequence
  synthetic polypeptide
DSYSMN

SEQ ID NO: 4507 - protein, 6 aa, Artificial Sequence
  synthetic polypeptide
SSYSMN

SEQ ID NO: 4508 - protein, 6 aa, Artificial Sequence
  synthetic polypeptide
DSYSMN

SEQ ID NO: 4509 - protein, 6 aa, Artificial Sequence
  synthetic polypeptide
DSYSMN

SEQ ID NO: 4510 - protein, 6 aa, Artificial Sequence
  synthetic polypeptide
SSYGMH

SEQ ID NO: 4511 - protein, 6 aa, Artificial Sequence
  synthetic polypeptide
SSYSMN

SEQ ID NO: 4512 - protein, 6 aa, Artificial Sequence
  synthetic polypeptide
SSYGMN

SEQ ID NO: 4513 - protein, 6 aa, Artificial Sequence
  synthetic polypeptide
DSYSMN

SEQ ID NO: 4514 - protein, 6 aa, Artificial Sequence
  synthetic polypeptide
DSYSMN

SEQ ID NO: 4515 - protein, 6 aa, Artificial Sequence
  synthetic polypeptide
DSYSMN

SEQ ID NO: 4516 - protein, 6 aa, Artificial Sequence
  synthetic polypeptide
SDYSMN

SEQ ID NO: 4517 - protein, 6 aa, Artificial Sequence
  synthetic polypeptide
SSYSMN

SEQ ID NO: 4518 - protein, 6 aa, Artificial Sequence
  synthetic polypeptide
DDYGMN

SEQ ID NO: 4519 - protein, 6 aa, Artificial Sequence
  synthetic polypeptide
DSYGMH

SEQ ID NO: 4520 - protein, 6 aa, Artificial Sequence
  synthetic polypeptide
DSYGMH

SEQ ID NO: 4521 - protein, 6 aa, Artificial Sequence
  synthetic polypeptide
DSYSMN

SEQ ID NO: 4522 - protein, 6 aa, Artificial Sequence
  synthetic polypeptide
DSYSMN

SEQ ID NO: 4523 - protein, 6 aa, Artificial Sequence
  synthetic polypeptide
SDYSMN

SEQ ID NO: 4524 - protein, 6 aa, Artificial Sequence
  synthetic polypeptide
SSYSMN

SEQ ID NO: 4525 - protein, 6 aa, Artificial Sequence
  synthetic polypeptide
DSYSMN

SEQ ID NO: 4526 - protein, 6 aa, Artificial Sequence
  synthetic polypeptide
SSYSMN

SEQ ID NO: 4527 - protein, 6 aa, Artificial Sequence
  synthetic polypeptide
SDYGMN

SEQ ID NO: 4528 - protein, 6 aa, Artificial Sequence
  synthetic polypeptide
SSYSMN

SEQ ID NO: 4529 - protein, 6 aa, Artificial Sequence
  synthetic polypeptide
DSYGMH

SEQ ID NO: 4530 - protein, 6 aa, Artificial Sequence
  synthetic polypeptide
DSYGMH

SEQ ID NO: 4531 - protein, 6 aa, Artificial Sequence
  synthetic polypeptide
SDYGMH

SEQ ID NO: 4532 - protein, 6 aa, Artificial Sequence
  synthetic polypeptide
SSYGMH

SEQ ID NO: 4533 - protein, 6 aa, Artificial Sequence
  synthetic polypeptide
SSYGMN

SEQ ID NO: 4534 - protein, 6 aa, Artificial Sequence
  synthetic polypeptide
SSYSMN

SEQ ID NO: 4535 - protein, 6 aa, Artificial Sequence
  synthetic polypeptide
DSYSMN

SEQ ID NO: 4536 - protein, 6 aa, Artificial Sequence
  synthetic polypeptide
DDYSMN

SEQ ID NO: 4537 - protein, 6 aa, Artificial Sequence
  synthetic polypeptide
SSYSMN

SEQ ID NO: 4538 - protein, 6 aa, Artificial Sequence
  synthetic polypeptide
SSYSMN

SEQ ID NO: 4539 - protein, 6 aa, Artificial Sequence
  synthetic polypeptide
SDYGMH

SEQ ID NO: 4540 - protein, 6 aa, Artificial Sequence
  synthetic polypeptide
SSYGMH

SEQ ID NO: 4541 - protein, 6 aa, Artificial Sequence
  synthetic polypeptide
SSYGMN

SEQ ID NO: 4542 - protein, 6 aa, Artificial Sequence
  synthetic polypeptide
DSYGMH

SEQ ID NO: 4543 - protein, 6 aa, Artificial Sequence
  synthetic polypeptide
SDYSMN

SEQ ID NO: 4544 - protein, 6 aa, Artificial Sequence
  synthetic polypeptide
DSYSMN

SEQ ID NO: 4545 - protein, 6 aa, Artificial Sequence
  synthetic polypeptide
DSYSMN

SEQ ID NO: 4546 - protein, 6 aa, Artificial Sequence
  synthetic polypeptide
DSYSMN

SEQ ID NO: 4547 - protein, 6 aa, Artificial Sequence
  synthetic polypeptide
SDYGMN

SEQ ID NO: 4548 - protein, 6 aa, Artificial Sequence
  synthetic polypeptide
SSYSMN

SEQ ID NO: 4549 - protein, 6 aa, Artificial Sequence
  synthetic polypeptide
DSYSMN

SEQ ID NO: 4550 - protein, 6 aa, Artificial Sequence
  synthetic polypeptide
DSYSMN

SEQ ID NO: 4551 - protein, 6 aa, Artificial Sequence
  synthetic polypeptide
DSYSMN

SEQ ID NO: 4552 - protein, 6 aa, Artificial Sequence
  synthetic polypeptide
DSYSMN

SEQ ID NO: 4553 - protein, 6 aa, Artificial Sequence
  synthetic polypeptide
DSYSMN

SEQ ID NO: 4554 - protein, 6 aa, Artificial Sequence
  synthetic polypeptide
SSYGMH

SEQ ID NO: 4555 - protein, 6 aa, Artificial Sequence
  synthetic polypeptide
SSYGMN

SEQ ID NO: 4556 - protein, 6 aa, Artificial Sequence
  synthetic polypeptide
DSYSMN

SEQ ID NO: 4557 - protein, 6 aa, Artificial Sequence
  synthetic polypeptide
SDYSMN

SEQ ID NO: 4558 - protein, 6 aa, Artificial Sequence
  synthetic polypeptide
SSYSMN

SEQ ID NO: 4559 - protein, 6 aa, Artificial Sequence
  synthetic polypeptide
SSYSMN

SEQ ID NO: 4560 - protein, 6 aa, Artificial Sequence
  synthetic polypeptide
DDYSMN

SEQ ID NO: 4561 - protein, 6 aa, Artificial Sequence
  synthetic polypeptide
DSYSMN

SEQ ID NO: 4562 - protein, 6 aa, Artificial Sequence
  synthetic polypeptide
DSYSMN

SEQ ID NO: 4563 - protein, 6 aa, Artificial Sequence
  synthetic polypeptide
SDYGMN

SEQ ID NO: 4564 - protein, 6 aa, Artificial Sequence
  synthetic polypeptide
SDYSMN

SEQ ID NO: 4565 - protein, 6 aa, Artificial Sequence
  synthetic polypeptide
SSYSMN

SEQ ID NO: 4566 - protein, 6 aa, Artificial Sequence
  synthetic polypeptide
SSYSMN

SEQ ID NO: 4567 - protein, 6 aa, Artificial Sequence
  synthetic polypeptide
SSYSMN

SEQ ID NO: 4568 - protein, 6 aa, Artificial Sequence
  synthetic polypeptide
DSYGMN

SEQ ID NO: 4569 - protein, 6 aa, Artificial Sequence
  synthetic polypeptide
DSYSMN

SEQ ID NO: 4570 - protein, 6 aa, Artificial Sequence
  synthetic polypeptide
DSYSMN

SEQ ID NO: 4571 - protein, 6 aa, Artificial Sequence
  synthetic polypeptide
DSYSMN

SEQ ID NO: 4572 - protein, 6 aa, Artificial Sequence
  synthetic polypeptide
DSYSMN

SEQ ID NO: 4573 - protein, 6 aa, Artificial Sequence
  synthetic polypeptide
SDYSMN

SEQ ID NO: 4574 - protein, 6 aa, Artificial Sequence
  synthetic polypeptide
SSYSMN

SEQ ID NO: 4575 - protein, 6 aa, Artificial Sequence
  synthetic polypeptide
DSYGMN

SEQ ID NO: 4576 - protein, 6 aa, Artificial Sequence
  synthetic polypeptide
DSYGMN

SEQ ID NO: 4577 - protein, 6 aa, Artificial Sequence
  synthetic polypeptide
DSYGMN

SEQ ID NO: 4578 - protein, 6 aa, Artificial Sequence
  synthetic polypeptide
DSYGMN

SEQ ID NO: 4579 - protein, 6 aa, Artificial Sequence
  synthetic polypeptide
DSYSMN

SEQ ID NO: 4580 - protein, 6 aa, Artificial Sequence
  synthetic polypeptide
DSYGMN

SEQ ID NO: 4581 - protein, 6 aa, Artificial Sequence
  synthetic polypeptide
DSYGMN

SEQ ID NO: 4582 - protein, 6 aa, Artificial Sequence
  synthetic polypeptide
DSYSMN

SEQ ID NO: 4583 - protein, 6 aa, Artificial Sequence
  synthetic polypeptide
DSYSMN

SEQ ID NO: 4584 - protein, 6 aa, Artificial Sequence
  synthetic polypeptide
DSYSMN

SEQ ID NO: 4585 - protein, 6 aa, Artificial Sequence
  synthetic polypeptide
SDYGMN

SEQ ID NO: 4586 - protein, 6 aa, Artificial Sequence
  synthetic polypeptide
SDYGMN

SEQ ID NO: 4587 - protein, 6 aa, Artificial Sequence
  synthetic polypeptide
SSYSMN

SEQ ID NO: 4588 - protein, 6 aa, Artificial Sequence
  synthetic polypeptide
DDYSMN

SEQ ID NO: 4589 - protein, 6 aa, Artificial Sequence
  synthetic polypeptide
DSYSMN

SEQ ID NO: 4590 - protein, 6 aa, Artificial Sequence
  synthetic polypeptide
DSYSMN

SEQ ID NO: 4591 - protein, 6 aa, Artificial Sequence
  synthetic polypeptide
DSYSMN

SEQ ID NO: 4592 - protein, 6 aa, Artificial Sequence
  synthetic polypeptide
DSYSMN

SEQ ID NO: 4593 - protein, 6 aa, Artificial Sequence
  synthetic polypeptide
SSYSMN

SEQ ID NO: 4594 - protein, 6 aa, Artificial Sequence
  synthetic polypeptide
DDYSMN

SEQ ID NO: 4595 - protein, 6 aa, Artificial Sequence
  synthetic polypeptide
DSYSMN

SEQ ID NO: 4596 - protein, 6 aa, Artificial Sequence
  synthetic polypeptide
SDYSMN

SEQ ID NO: 4597 - protein, 6 aa, Artificial Sequence
  synthetic polypeptide
SSYSMN

SEQ ID NO: 4598 - protein, 6 aa, Artificial Sequence
  synthetic polypeptide
SSYSMN

SEQ ID NO: 4599 - protein, 6 aa, Artificial Sequence
  synthetic polypeptide
DSYGMN

SEQ ID NO: 4600 - protein, 6 aa, Artificial Sequence
  synthetic polypeptide
SSYGMN

SEQ ID NO: 4601 - protein, 6 aa, Artificial Sequence
  synthetic polypeptide
DSYSMN

SEQ ID NO: 4602 - protein, 6 aa, Artificial Sequence
  synthetic polypeptide
DSYSMN

SEQ ID NO: 4603 - protein, 6 aa, Artificial Sequence
  synthetic polypeptide
DDYGMN

SEQ ID NO: 4604 - protein, 6 aa, Artificial Sequence
  synthetic polypeptide
SSYGMN

SEQ ID NO: 4605 - protein, 6 aa, Artificial Sequence
  synthetic polypeptide
SDYGMN

SEQ ID NO: 4606 - protein, 6 aa, Artificial Sequence
  synthetic polypeptide
DSYGMH

SEQ ID NO: 4607 - protein, 6 aa, Artificial Sequence
  synthetic polypeptide
SDYGMN

SEQ ID NO: 4608 - protein, 6 aa, Artificial Sequence
  synthetic polypeptide
SSYSMH

SEQ ID NO: 4609 - protein, 6 aa, Artificial Sequence
  synthetic polypeptide
SSYSMN

SEQ ID NO: 4610 - protein, 6 aa, Artificial Sequence
  synthetic polypeptide
DSYSMN

SEQ ID NO: 4611 - protein, 6 aa, Artificial Sequence
  synthetic polypeptide
SDYSMN

SEQ ID NO: 4612 - protein, 6 aa, Artificial Sequence
  synthetic polypeptide
SSYSMN

SEQ ID NO: 4613 - protein, 6 aa, Artificial Sequence
  synthetic polypeptide
DDYGMN

SEQ ID NO: 4614 - protein, 6 aa, Artificial Sequence
  synthetic polypeptide
SSYGMN

SEQ ID NO: 4615 - protein, 6 aa, Artificial Sequence
  synthetic polypeptide
DSYSMN

SEQ ID NO: 4616 - protein, 6 aa, Artificial Sequence
  synthetic polypeptide
DSYSMN

SEQ ID NO: 4617 - protein, 6 aa, Artificial Sequence
  synthetic polypeptide
SSYSMN

SEQ ID NO: 4618 - protein, 6 aa, Artificial Sequence
  synthetic polypeptide
SSYGMN

SEQ ID NO: 4619 - protein, 13 aa, Artificial Sequence
  synthetic polypeptide
WVANINYNGGYTS

SEQ ID NO: 4620 - protein, 13 aa, Artificial Sequence
  synthetic polypeptide
WVAGINYNGGYKG

SEQ ID NO: 4621 - protein, 13 aa, Artificial Sequence
  synthetic polypeptide
WVAGINYNGGYTG

SEQ ID NO: 4622 - protein, 13 aa, Artificial Sequence
  synthetic polypeptide
WVAGINYNGGYTS

SEQ ID NO: 4623 - protein, 13 aa, Artificial Sequence
  synthetic polypeptide
WVAGINYNSGYTS

SEQ ID NO: 4624 - protein, 13 aa, Artificial Sequence
  synthetic polypeptide
WVAGINYNSGYTS

SEQ ID NO: 4625 - protein, 13 aa, Artificial Sequence
  synthetic polypeptide
WVANINYNGGYTG

SEQ ID NO: 4626 - protein, 13 aa, Artificial Sequence
  synthetic polypeptide
WVANINYNGGYTG

SEQ ID NO: 4627 - protein, 13 aa, Artificial Sequence
  synthetic polypeptide
WVANINYNGGYTS

SEQ ID NO: 4628 - protein, 13 aa, Artificial Sequence
  synthetic polypeptide
WVANINYNGGYTS

SEQ ID NO: 4629 - protein, 13 aa, Artificial Sequence
  synthetic polypeptide
WVASINYNGGYTG

SEQ ID NO: 4630 - protein, 13 aa, Artificial Sequence
  synthetic polypeptide
WVASINYNGGYTS

SEQ ID NO: 4631 - protein, 13 aa, Artificial Sequence
  synthetic polypeptide
WVSGINYNSGYKS

SEQ ID NO: 4632 - protein, 13 aa, Artificial Sequence
  synthetic polypeptide
WVSGINYNSGYTS

SEQ ID NO: 4633 - protein, 13 aa, Artificial Sequence
  synthetic polypeptide
WVSGINYNSGYTS

SEQ ID NO: 4634 - protein, 13 aa, Artificial Sequence
  synthetic polypeptide
WVSNINYNGGYKS

SEQ ID NO: 4635 - protein, 13 aa, Artificial Sequence
  synthetic polypeptide
WVSNINYNGGYKS

SEQ ID NO: 4636 - protein, 13 aa, Artificial Sequence
  synthetic polypeptide
WVSNINYNGGYTG

SEQ ID NO: 4637 - protein, 13 aa, Artificial Sequence
  synthetic polypeptide
WVAGINYNGGYKG

SEQ ID NO: 4638 - protein, 13 aa, Artificial Sequence
  synthetic polypeptide
WVAGINYNGGYKS

SEQ ID NO: 4639 - protein, 13 aa, Artificial Sequence
  synthetic polypeptide
WVAGINYNGGYKS

SEQ ID NO: 4640 - protein, 13 aa, Artificial Sequence
  synthetic polypeptide
WVAGINYNGGYKS

SEQ ID NO: 4641 - protein, 13 aa, Artificial Sequence
  synthetic polypeptide
WVAGINYNGGYKS

SEQ ID NO: 4642 - protein, 13 aa, Artificial Sequence
  synthetic polypeptide
WVAGINYNGGYTG

SEQ ID NO: 4643 - protein, 13 aa, Artificial Sequence
  synthetic polypeptide
WVAGINYNGGYTG

SEQ ID NO: 4644 - protein, 13 aa, Artificial Sequence
  synthetic polypeptide
WVAGINYNGGYTG

SEQ ID NO: 4645 - protein, 13 aa, Artificial Sequence
  synthetic polypeptide
WVAGINYNGGYTG

SEQ ID NO: 4646 - protein, 13 aa, Artificial Sequence
  synthetic polypeptide
WVAGINYNGGYTG

SEQ ID NO: 4647 - protein, 13 aa, Artificial Sequence
  synthetic polypeptide
WVAGINYNGGYTG

SEQ ID NO: 4648 - protein, 13 aa, Artificial Sequence
  synthetic polypeptide
WVAGINYNGGYTG

SEQ ID NO: 4649 - protein, 13 aa, Artificial Sequence
  synthetic polypeptide
WVAGINYNGGYTS

SEQ ID NO: 4650 - protein, 13 aa, Artificial Sequence
  synthetic polypeptide
WVAGINYNGGYTS

SEQ ID NO: 4651 - protein, 13 aa, Artificial Sequence
  synthetic polypeptide
WVAGINYNGGYTS

SEQ ID NO: 4652 - protein, 13 aa, Artificial Sequence
  synthetic polypeptide
WVAGINYNGGYTS

SEQ ID NO: 4653 - protein, 13 aa, Artificial Sequence
  synthetic polypeptide
WVAGINYNGGYTS

SEQ ID NO: 4654 - protein, 13 aa, Artificial Sequence
  synthetic polypeptide
WVAGINYNGGYTS

SEQ ID NO: 4655 - protein, 13 aa, Artificial Sequence
  synthetic polypeptide
WVAGINYNGGYTS

SEQ ID NO: 4656 - protein, 13 aa, Artificial Sequence
  synthetic polypeptide
WVAGINYNGGYTS

SEQ ID NO: 4657 - protein, 13 aa, Artificial Sequence
  synthetic polypeptide
WVAGINYNGGYTS

SEQ ID NO: 4658 - protein, 13 aa, Artificial Sequence
  synthetic polypeptide
WVAGINYNGGYTS

SEQ ID NO: 4659 - protein, 13 aa, Artificial Sequence
  synthetic polypeptide
WVAGINYNSGYKG

SEQ ID NO: 4660 - protein, 13 aa, Artificial Sequence
  synthetic polypeptide
WVAGINYNSGYKG

SEQ ID NO: 4661 - protein, 13 aa, Artificial Sequence
  synthetic polypeptide
WVAGINYNSGYKG

SEQ ID NO: 4662 - protein, 13 aa, Artificial Sequence
  synthetic polypeptide
WVAGINYNSGYKG

SEQ ID NO: 4663 - protein, 13 aa, Artificial Sequence
  synthetic polypeptide
WVAGINYNSGYKG

SEQ ID NO: 4664 - protein, 13 aa, Artificial Sequence
  synthetic polypeptide
WVAGINYNSGYKG

SEQ ID NO: 4665 - protein, 13 aa, Artificial Sequence
  synthetic polypeptide
WVAGINYNSGYKG

SEQ ID NO: 4666 - protein, 13 aa, Artificial Sequence
  synthetic polypeptide
WVAGINYNSGYKS

SEQ ID NO: 4667 - protein, 13 aa, Artificial Sequence
  synthetic polypeptide
WVAGINYNSGYKS

SEQ ID NO: 4668 - protein, 13 aa, Artificial Sequence
  synthetic polypeptide
WVAGINYNSGYKS

SEQ ID NO: 4669 - protein, 13 aa, Artificial Sequence
  synthetic polypeptide
WVAGINYNSGYKS

SEQ ID NO: 4670 - protein, 13 aa, Artificial Sequence
  synthetic polypeptide
WVAGINYNSGYKS

SEQ ID NO: 4671 - protein, 13 aa, Artificial Sequence
  synthetic polypeptide
WVAGINYNSGYKS

SEQ ID NO: 4672 - protein, 13 aa, Artificial Sequence
  synthetic polypeptide
WVAGINYNSGYKS

SEQ ID NO: 4673 - protein, 13 aa, Artificial Sequence
  synthetic polypeptide
WVAGINYNSGYKS

SEQ ID NO: 4674 - protein, 13 aa, Artificial Sequence
  synthetic polypeptide
WVAGINYNSGYKS

SEQ ID NO: 4675 - protein, 13 aa, Artificial Sequence
  synthetic polypeptide
WVAGINYNSGYTG

SEQ ID NO: 4676 - protein, 13 aa, Artificial Sequence
  synthetic polypeptide
WVAGINYNSGYTG

SEQ ID NO: 4677 - protein, 13 aa, Artificial Sequence
  synthetic polypeptide
WVAGINYNSGYTS

SEQ ID NO: 4678 - protein, 13 aa, Artificial Sequence
  synthetic polypeptide
WVAGINYNSGYTS

SEQ ID NO: 4679 - protein, 13 aa, Artificial Sequence
  synthetic polypeptide
WVAGINYNSGYTS

SEQ ID NO: 4680 - protein, 13 aa, Artificial Sequence
  synthetic polypeptide
WVAGINYNSGYTS

SEQ ID NO: 4681 - protein, 13 aa, Artificial Sequence
  synthetic polypeptide
WVANINYNGGYKG

SEQ ID NO: 4682 - protein, 13 aa, Artificial Sequence
  synthetic polypeptide
WVANINYNGGYTG

SEQ ID NO: 4683 - protein, 13 aa, Artificial Sequence
  synthetic polypeptide
WVANINYNGGYTG

SEQ ID NO: 4684 - protein, 13 aa, Artificial Sequence
  synthetic polypeptide
WVANINYNGGYTG

SEQ ID NO: 4685 - protein, 13 aa, Artificial Sequence
  synthetic polypeptide
WVANINYNGGYTG

SEQ ID NO: 4686 - protein, 13 aa, Artificial Sequence
  synthetic polypeptide
WVANINYNGGYTG

SEQ ID NO: 4687 - protein, 13 aa, Artificial Sequence
  synthetic polypeptide
WVANINYNGGYTS

SEQ ID NO: 4688 - protein, 13 aa, Artificial Sequence
  synthetic polypeptide
WVANINYNGGYTS

SEQ ID NO: 4689 - protein, 13 aa, Artificial Sequence
  synthetic polypeptide
WVANINYNGGYTS

SEQ ID NO: 4690 - protein, 13 aa, Artificial Sequence
  synthetic polypeptide
WVANINYNGGYTS

SEQ ID NO: 4691 - protein, 13 aa, Artificial Sequence
  synthetic polypeptide
WVANINYNSGYKG

SEQ ID NO: 4692 - protein, 13 aa, Artificial Sequence
  synthetic polypeptide
WVANINYNSGYKG

SEQ ID NO: 4693 - protein, 13 aa, Artificial Sequence
  synthetic polypeptide
WVANINYNSGYKG

SEQ ID NO: 4694 - protein, 13 aa, Artificial Sequence
  synthetic polypeptide
WVANINYNSGYTG

SEQ ID NO: 4695 - protein, 13 aa, Artificial Sequence
  synthetic polypeptide
WVANINYNSGYTG

SEQ ID NO: 4696 - protein, 13 aa, Artificial Sequence
  synthetic polypeptide
WVASINYNGGYTG

SEQ ID NO: 4697 - protein, 13 aa, Artificial Sequence
  synthetic polypeptide
WVASINYNGGYTG

SEQ ID NO: 4698 - protein, 13 aa, Artificial Sequence
  synthetic polypeptide
WVASINYNGGYTS

SEQ ID NO: 4699 - protein, 13 aa, Artificial Sequence
  synthetic polypeptide
WVASINYNGGYTS

SEQ ID NO: 4700 - protein, 13 aa, Artificial Sequence
  synthetic polypeptide
WVASINYNGGYTS

SEQ ID NO: 4701 - protein, 13 aa, Artificial Sequence
  synthetic polypeptide
WVASINYNGGYTS

SEQ ID NO: 4702 - protein, 13 aa, Artificial Sequence
  synthetic polypeptide
WVASINYNGGYTS

SEQ ID NO: 4703 - protein, 13 aa, Artificial Sequence
  synthetic polypeptide
WVASINYNGGYTS

SEQ ID NO: 4704 - protein, 13 aa, Artificial Sequence
  synthetic polypeptide
WVASINYNSGYKG

SEQ ID NO: 4705 - protein, 13 aa, Artificial Sequence
  synthetic polypeptide
WVASINYNSGYKS

SEQ ID NO: 4706 - protein, 13 aa, Artificial Sequence
  synthetic polypeptide
WVASINYNSGYKS

SEQ ID NO: 4707 - protein, 13 aa, Artificial Sequence
  synthetic polypeptide
WVASINYNSGYKS

SEQ ID NO: 4708 - protein, 13 aa, Artificial Sequence
  synthetic polypeptide
WVASINYNSGYTS

SEQ ID NO: 4709 - protein, 13 aa, Artificial Sequence
  synthetic polypeptide
WVASINYNSGYTS

SEQ ID NO: 4710 - protein, 13 aa, Artificial Sequence
  synthetic polypeptide
WVASINYNSGYTS

SEQ ID NO: 4711 - protein, 13 aa, Artificial Sequence
  synthetic polypeptide
WVSGINYNGGYKG

SEQ ID NO: 4712 - protein, 13 aa, Artificial Sequence
  synthetic polypeptide
WVSGINYNGGYKG

SEQ ID NO: 4713 - protein, 13 aa, Artificial Sequence
  synthetic polypeptide
WVSGINYNGGYKS

SEQ ID NO: 4714 - protein, 13 aa, Artificial Sequence
  synthetic polypeptide
WVSGINYNGGYKS

SEQ ID NO: 4715 - protein, 13 aa, Artificial Sequence
  synthetic polypeptide
WVSGINYNGGYKS

SEQ ID NO: 4716 - protein, 13 aa, Artificial Sequence
  synthetic polypeptide
WVSGINYNGGYKS

SEQ ID NO: 4717 - protein, 13 aa, Artificial Sequence
  synthetic polypeptide
WVSGINYNGGYKS

SEQ ID NO: 4718 - protein, 13 aa, Artificial Sequence
  synthetic polypeptide
WVSGINYNGGYTG

SEQ ID NO: 4719 - protein, 13 aa, Artificial Sequence
  synthetic polypeptide
WVSGINYNGGYTG

SEQ ID NO: 4720 - protein, 13 aa, Artificial Sequence
  synthetic polypeptide
WVSGINYNGGYTG

SEQ ID NO: 4721 - protein, 13 aa, Artificial Sequence
  synthetic polypeptide
WVSGINYNGGYTG

SEQ ID NO: 4722 - protein, 13 aa, Artificial Sequence
  synthetic polypeptide
WVSGINYNGGYTS

SEQ ID NO: 4723 - protein, 13 aa, Artificial Sequence
  synthetic polypeptide
WVSGINYNGGYTS

SEQ ID NO: 4724 - protein, 13 aa, Artificial Sequence
  synthetic polypeptide
WVSGINYNGGYTS

SEQ ID NO: 4725 - protein, 13 aa, Artificial Sequence
  synthetic polypeptide
WVSGINYNSGYKG

SEQ ID NO: 4726 - protein, 13 aa, Artificial Sequence
  synthetic polypeptide
WVSGINYNSGYKG

SEQ ID NO: 4727 - protein, 13 aa, Artificial Sequence
  synthetic polypeptide
WVSGINYNSGYKG

SEQ ID NO: 4728 - protein, 13 aa, Artificial Sequence
  synthetic polypeptide
WVSGINYNSGYKG

SEQ ID NO: 4729 - protein, 13 aa, Artificial Sequence
  synthetic polypeptide
WVSGINYNSGYKS

SEQ ID NO: 4730 - protein, 13 aa, Artificial Sequence
  synthetic polypeptide
WVSGINYNSGYKS

SEQ ID NO: 4731 - protein, 13 aa, Artificial Sequence
  synthetic polypeptide
WVSGINYNSGYKS

SEQ ID NO: 4732 - protein, 13 aa, Artificial Sequence
  synthetic polypeptide
WVSGINYNSGYKS

SEQ ID NO: 4733 - protein, 13 aa, Artificial Sequence
  synthetic polypeptide
WVSGINYNSGYKS

SEQ ID NO: 4734 - protein, 13 aa, Artificial Sequence
  synthetic polypeptide
WVSGINYNSGYKS

SEQ ID NO: 4735 - protein, 13 aa, Artificial Sequence
  synthetic polypeptide
WVSGINYNSGYKS

SEQ ID NO: 4736 - protein, 13 aa, Artificial Sequence
  synthetic polypeptide
WVSGINYNSGYKS

SEQ ID NO: 4737 - protein, 13 aa, Artificial Sequence
  synthetic polypeptide
WVSGINYNSGYTS

SEQ ID NO: 4738 - protein, 13 aa, Artificial Sequence
  synthetic polypeptide
WVSGINYNSGYTS

SEQ ID NO: 4739 - protein, 13 aa, Artificial Sequence
  synthetic polypeptide
WVSGINYNSGYTS

SEQ ID NO: 4740 - protein, 13 aa, Artificial Sequence
  synthetic polypeptide
WVSGINYNSGYTS

SEQ ID NO: 4741 - protein, 13 aa, Artificial Sequence
  synthetic polypeptide
WVSGINYNSGYTS

SEQ ID NO: 4742 - protein, 13 aa, Artificial Sequence
  synthetic polypeptide
WVSGINYNSGYTS

SEQ ID NO: 4743 - protein, 13 aa, Artificial Sequence
  synthetic polypeptide
WVSGINYNSGYTS

SEQ ID NO: 4744 - protein, 13 aa, Artificial Sequence
  synthetic polypeptide
WVSNINYNGGYKG

SEQ ID NO: 4745 - protein, 13 aa, Artificial Sequence
  synthetic polypeptide
WVSNINYNGGYKG

SEQ ID NO: 4746 - protein, 13 aa, Artificial Sequence
  synthetic polypeptide
WVSNINYNGGYKS

SEQ ID NO: 4747 - protein, 13 aa, Artificial Sequence
  synthetic polypeptide
WVSNINYNGGYKS

SEQ ID NO: 4748 - protein, 13 aa, Artificial Sequence
  synthetic polypeptide
WVSNINYNGGYKS

SEQ ID NO: 4749 - protein, 13 aa, Artificial Sequence
  synthetic polypeptide
WVSNINYNGGYTG

SEQ ID NO: 4750 - protein, 13 aa, Artificial Sequence
  synthetic polypeptide
WVSNINYNGGYTG

SEQ ID NO: 4751 - protein, 13 aa, Artificial Sequence
  synthetic polypeptide
WVSNINYNGGYTG

SEQ ID NO: 4752 - protein, 13 aa, Artificial Sequence
  synthetic polypeptide
WVSNINYNGGYTG

SEQ ID NO: 4753 - protein, 13 aa, Artificial Sequence
  synthetic polypeptide
WVSNINYNGGYTG

SEQ ID NO: 4754 - protein, 13 aa, Artificial Sequence
  synthetic polypeptide
WVSNINYNGGYTG

SEQ ID NO: 4755 - protein, 13 aa, Artificial Sequence
  synthetic polypeptide
WVSNINYNGGYTG

SEQ ID NO: 4756 - protein, 13 aa, Artificial Sequence
  synthetic polypeptide
WVSNINYNGGYTG

SEQ ID NO: 4757 - protein, 13 aa, Artificial Sequence
  synthetic polypeptide
WVSNINYNGGYTS

SEQ ID NO: 4758 - protein, 13 aa, Artificial Sequence
  synthetic polypeptide
WVSNINYNGGYTS

SEQ ID NO: 4759 - protein, 13 aa, Artificial Sequence
  synthetic polypeptide
WVSNINYNGGYTS

SEQ ID NO: 4760 - protein, 13 aa, Artificial Sequence
  synthetic polypeptide
WVSNINYNGGYTS

SEQ ID NO: 4761 - protein, 13 aa, Artificial Sequence
  synthetic polypeptide
WVSNINYNGGYTS

SEQ ID NO: 4762 - protein, 13 aa, Artificial Sequence
  synthetic polypeptide
WVSNINYNGGYTS

SEQ ID NO: 4763 - protein, 13 aa, Artificial Sequence
  synthetic polypeptide
WVSNINYNSGYKG

SEQ ID NO: 4764 - protein, 13 aa, Artificial Sequence
  synthetic polypeptide
WVSNINYNSGYKG

SEQ ID NO: 4765 - protein, 13 aa, Artificial Sequence
  synthetic polypeptide
WVSNINYNSGYKG

SEQ ID NO: 4766 - protein, 13 aa, Artificial Sequence
  synthetic polypeptide
WVSNINYNSGYKG

SEQ ID NO: 4767 - protein, 13 aa, Artificial Sequence
  synthetic polypeptide
WVSNINYNSGYKG

SEQ ID NO: 4768 - protein, 13 aa, Artificial Sequence
  synthetic polypeptide
WVSNINYNSGYTG

SEQ ID NO: 4769 - protein, 13 aa, Artificial Sequence
  synthetic polypeptide
WVSNINYNSGYTG

SEQ ID NO: 4770 - protein, 13 aa, Artificial Sequence
  synthetic polypeptide
WVSNINYNSGYTS

SEQ ID NO: 4771 - protein, 13 aa, Artificial Sequence
  synthetic polypeptide
WVSNINYNSGYTS

SEQ ID NO: 4772 - protein, 13 aa, Artificial Sequence
  synthetic polypeptide
WVSSINYNGGYKS

SEQ ID NO: 4773 - protein, 13 aa, Artificial Sequence
  synthetic polypeptide
WVSSINYNGGYKS

SEQ ID NO: 4774 - protein, 13 aa, Artificial Sequence
  synthetic polypeptide
WVSSINYNGGYTG

SEQ ID NO: 4775 - protein, 13 aa, Artificial Sequence
  synthetic polypeptide
WVSSINYNGGYTS

SEQ ID NO: 4776 - protein, 13 aa, Artificial Sequence
  synthetic polypeptide
WVSSINYNGGYTS

SEQ ID NO: 4777 - protein, 13 aa, Artificial Sequence
  synthetic polypeptide
WVSSINYNGGYTS

SEQ ID NO: 4778 - protein, 13 aa, Artificial Sequence
  synthetic polypeptide
WVSSINYNGGYTS

SEQ ID NO: 4779 - protein, 13 aa, Artificial Sequence
  synthetic polypeptide
WVSSINYNSGYKG

SEQ ID NO: 4780 - protein, 13 aa, Artificial Sequence
  synthetic polypeptide
WVSSINYNSGYKG

SEQ ID NO: 4781 - protein, 13 aa, Artificial Sequence
  synthetic polypeptide
WVSSINYNSGYKG

SEQ ID NO: 4782 - protein, 13 aa, Artificial Sequence
  synthetic polypeptide
WVSSINYNSGYKS

SEQ ID NO: 4783 - protein, 13 aa, Artificial Sequence
  synthetic polypeptide
WVSSINYNSGYKS

SEQ ID NO: 4784 - protein, 13 aa, Artificial Sequence
  synthetic polypeptide
WVSSINYNSGYTG

SEQ ID NO: 4785 - protein, 13 aa, Artificial Sequence
  synthetic polypeptide
WVSSINYNSGYTG

SEQ ID NO: 4786 - protein, 13 aa, Artificial Sequence
  synthetic polypeptide
WVSSINYNSGYTG

SEQ ID NO: 4787 - protein, 13 aa, Artificial Sequence
  synthetic polypeptide
WVSSINYNSGYTS

SEQ ID NO: 4788 - protein, 12 aa, Artificial Sequence
  synthetic polypeptide
AKSATWHDTHLD

SEQ ID NO: 4789 - protein, 12 aa, Artificial Sequence
  synthetic polypeptide
ARSATWHDTALD

SEQ ID NO: 4790 - protein, 12 aa, Artificial Sequence
  synthetic polypeptide
ARSATWHDTALD

SEQ ID NO: 4791 - protein, 12 aa, Artificial Sequence
  synthetic polypeptide
ARSATWHDTALD

SEQ ID NO: 4792 - protein, 12 aa, Artificial Sequence
  synthetic polypeptide
ARSATWHDTALD

SEQ ID NO: 4793 - protein, 12 aa, Artificial Sequence
  synthetic polypeptide
ARSATWHDTALD

SEQ ID NO: 4794 - protein, 12 aa, Artificial Sequence
  synthetic polypeptide
ARSATWHDTALD

SEQ ID NO: 4795 - protein, 12 aa, Artificial Sequence
  synthetic polypeptide
ARSATWHDTALD

SEQ ID NO: 4796 - protein, 12 aa, Artificial Sequence
  synthetic polypeptide
ARSATWHDTALD

SEQ ID NO: 4797 - protein, 12 aa, Artificial Sequence
  synthetic polypeptide
ARSATWHDTALD

SEQ ID NO: 4798 - protein, 12 aa, Artificial Sequence
  synthetic polypeptide
ARSATWHDTALD

SEQ ID NO: 4799 - protein, 12 aa, Artificial Sequence
  synthetic polypeptide
ARSATWHDTALD

SEQ ID NO: 4800 - protein, 12 aa, Artificial Sequence
  synthetic polypeptide
ARSATWHDTALD

SEQ ID NO: 4801 - protein, 12 aa, Artificial Sequence
  synthetic polypeptide
ARSATWHDTALD

SEQ ID NO: 4802 - protein, 12 aa, Artificial Sequence
  synthetic polypeptide
ARSATWHDTALD

SEQ ID NO: 4803 - protein, 12 aa, Artificial Sequence
  synthetic polypeptide
ARSATWHDTALD

SEQ ID NO: 4804 - protein, 12 aa, Artificial Sequence
  synthetic polypeptide
ARSATWHDTALD

SEQ ID NO: 4805 - protein, 12 aa, Artificial Sequence
  synthetic polypeptide
ARSATWHDTALD

SEQ ID NO: 4806 - protein, 12 aa, Artificial Sequence
  synthetic polypeptide
ARSATWHDTHLD

SEQ ID NO: 4807 - protein, 12 aa, Artificial Sequence
  synthetic polypeptide
ARSATWHDTHLD

SEQ ID NO: 4808 - protein, 12 aa, Artificial Sequence
  synthetic polypeptide
ARSATWHDTHLD

SEQ ID NO: 4809 - protein, 12 aa, Artificial Sequence
  synthetic polypeptide
ARSATWHDTHLD

SEQ ID NO: 4810 - protein, 12 aa, Artificial Sequence
  synthetic polypeptide
ARSATWHDTHLD

SEQ ID NO: 4811 - protein, 12 aa, Artificial Sequence
  synthetic polypeptide
ARSATWHDTHLD

SEQ ID NO: 4812 - protein, 12 aa, Artificial Sequence
  synthetic polypeptide
ARSATWHDTHLD

SEQ ID NO: 4813 - protein, 12 aa, Artificial Sequence
  synthetic polypeptide
ARSATWHDTHLD

SEQ ID NO: 4814 - protein, 12 aa, Artificial Sequence
  synthetic polypeptide
ARSATWHDTHLD

SEQ ID NO: 4815 - protein, 12 aa, Artificial Sequence
  synthetic polypeptide
ARSATWHDTHLD

SEQ ID NO: 4816 - protein, 12 aa, Artificial Sequence
  synthetic polypeptide
ARSATWHDTHLD

SEQ ID NO: 4817 - protein, 12 aa, Artificial Sequence
  synthetic polypeptide
ARSATWHDTHLD

SEQ ID NO: 4818 - protein, 12 aa, Artificial Sequence
  synthetic polypeptide
ARSATWHDTHLD

SEQ ID NO: 4819 - protein, 12 aa, Artificial Sequence
  synthetic polypeptide
ARSATWHDTHLD

SEQ ID NO: 4820 - protein, 12 aa, Artificial Sequence
  synthetic polypeptide
ARSATWHDTHLD

SEQ ID NO: 4821 - protein, 12 aa, Artificial Sequence
  synthetic polypeptide
ARSATWHDTHLD

SEQ ID NO: 4822 - protein, 12 aa, Artificial Sequence
  synthetic polypeptide
ARSATWHDTHLD

SEQ ID NO: 4823 - protein, 12 aa, Artificial Sequence
  synthetic polypeptide
ARSATWHDTHLD

SEQ ID NO: 4824 - protein, 12 aa, Artificial Sequence
  synthetic polypeptide
ARSATWHDTHLD

SEQ ID NO: 4825 - protein, 12 aa, Artificial Sequence
  synthetic polypeptide
ARSATWHDTHLD

SEQ ID NO: 4826 - protein, 12 aa, Artificial Sequence
  synthetic polypeptide
ARSATWHDTHLD

SEQ ID NO: 4827 - protein, 12 aa, Artificial Sequence
  synthetic polypeptide
ARSATWHDTHLD

SEQ ID NO: 4828 - protein, 12 aa, Artificial Sequence
  synthetic polypeptide
ARSATWHDTHLD

SEQ ID NO: 4829 - protein, 12 aa, Artificial Sequence
  synthetic polypeptide
ARSATWHDTHLD

SEQ ID NO: 4830 - protein, 12 aa, Artificial Sequence
  synthetic polypeptide
ARSATWHDTHLD

SEQ ID NO: 4831 - protein, 12 aa, Artificial Sequence
  synthetic polypeptide
ARSATWHDTHLD

SEQ ID NO: 4832 - protein, 12 aa, Artificial Sequence
  synthetic polypeptide
ARSATWHDTHLD

SEQ ID NO: 4833 - protein, 12 aa, Artificial Sequence
  synthetic polypeptide
ARSATWHDTHLD

SEQ ID NO: 4834 - protein, 12 aa, Artificial Sequence
  synthetic polypeptide
ARSATWHDTHLD

SEQ ID NO: 4835 - protein, 12 aa, Artificial Sequence
  synthetic polypeptide
ARSATWHDTHLD

SEQ ID NO: 4836 - protein, 12 aa, Artificial Sequence
  synthetic polypeptide
ARSATWHDTHLD

SEQ ID NO: 4837 - protein, 12 aa, Artificial Sequence
  synthetic polypeptide
ARSATWHDTHLD

SEQ ID NO: 4838 - protein, 12 aa, Artificial Sequence
  synthetic polypeptide
ARSATWHDTHLD

SEQ ID NO: 4839 - protein, 12 aa, Artificial Sequence
  synthetic polypeptide
ARSATWHDTHLD

SEQ ID NO: 4840 - protein, 12 aa, Artificial Sequence
  synthetic polypeptide
ARSATWHDTHLD

SEQ ID NO: 4841 - protein, 12 aa, Artificial Sequence
  synthetic polypeptide
ARSATWHDTHLD

SEQ ID NO: 4842 - protein, 12 aa, Artificial Sequence
  synthetic polypeptide
ARSATWHDTHLD

SEQ ID NO: 4843 - protein, 12 aa, Artificial Sequence
  synthetic polypeptide
ARSATWHDTHLD

SEQ ID NO: 4844 - protein, 12 aa, Artificial Sequence
  synthetic polypeptide
ARSATWHDTHLD

SEQ ID NO: 4845 - protein, 12 aa, Artificial Sequence
  synthetic polypeptide
ARSATWHDTHLD

SEQ ID NO: 4846 - protein, 12 aa, Artificial Sequence
  synthetic polypeptide
ARSATWHDTHLD

SEQ ID NO: 4847 - protein, 12 aa, Artificial Sequence
  synthetic polypeptide
ARSATWHDTHLD

SEQ ID NO: 4848 - protein, 12 aa, Artificial Sequence
  synthetic polypeptide
ARSATWHDTHLD

SEQ ID NO: 4849 - protein, 12 aa, Artificial Sequence
  synthetic polypeptide
ARSATWHDTHLD

SEQ ID NO: 4850 - protein, 12 aa, Artificial Sequence
  synthetic polypeptide
ARSATWHDTHLD

SEQ ID NO: 4851 - protein, 12 aa, Artificial Sequence
  synthetic polypeptide
ARSATWHDTHLD

SEQ ID NO: 4852 - protein, 12 aa, Artificial Sequence
  synthetic polypeptide
ARSATWHDTHLD

SEQ ID NO: 4853 - protein, 12 aa, Artificial Sequence
  synthetic polypeptide
ARSATWHDTHLD

SEQ ID NO: 4854 - protein, 12 aa, Artificial Sequence
  synthetic polypeptide
ARSATWHDTHLD

SEQ ID NO: 4855 - protein, 12 aa, Artificial Sequence
  synthetic polypeptide
ARSATWHDTHLD

SEQ ID NO: 4856 - protein, 12 aa, Artificial Sequence
  synthetic polypeptide
ARSATWHDTHLD

SEQ ID NO: 4857 - protein, 12 aa, Artificial Sequence
  synthetic polypeptide
ARSATWHDTHLD

SEQ ID NO: 4858 - protein, 12 aa, Artificial Sequence
  synthetic polypeptide
ARSATWHDTHLD

SEQ ID NO: 4859 - protein, 12 aa, Artificial Sequence
  synthetic polypeptide
ARSATWHDTHLD

SEQ ID NO: 4860 - protein, 12 aa, Artificial Sequence
  synthetic polypeptide
ARSATWHDTHLD

SEQ ID NO: 4861 - protein, 12 aa, Artificial Sequence
  synthetic polypeptide
ARSATWHDTHLD

SEQ ID NO: 4862 - protein, 12 aa, Artificial Sequence
  synthetic polypeptide
ARSATWHDTHLD

SEQ ID NO: 4863 - protein, 12 aa, Artificial Sequence
  synthetic polypeptide
ARSATWHDTHLD

SEQ ID NO: 4864 - protein, 12 aa, Artificial Sequence
  synthetic polypeptide
ARSATWHDTHLD

SEQ ID NO: 4865 - protein, 12 aa, Artificial Sequence
  synthetic polypeptide
ARSATWHDTHLD

SEQ ID NO: 4866 - protein, 12 aa, Artificial Sequence
  synthetic polypeptide
ARSATWHDTHLD

SEQ ID NO: 4867 - protein, 12 aa, Artificial Sequence
  synthetic polypeptide
ARSATWHDTHLD

SEQ ID NO: 4868 - protein, 12 aa, Artificial Sequence
  synthetic polypeptide
ARSATWHDTHLD

SEQ ID NO: 4869 - protein, 12 aa, Artificial Sequence
  synthetic polypeptide
ARSATWHDTHLD

SEQ ID NO: 4870 - protein, 12 aa, Artificial Sequence
  synthetic polypeptide
ARSATWHDTHLD

SEQ ID NO: 4871 - protein, 12 aa, Artificial Sequence
  synthetic polypeptide
ARSATWHDTHLD

SEQ ID NO: 4872 - protein, 12 aa, Artificial Sequence
  synthetic polypeptide
ARSATWHDTHLD

SEQ ID NO: 4873 - protein, 12 aa, Artificial Sequence
  synthetic polypeptide
ARSATWHDTHLD

SEQ ID NO: 4874 - protein, 12 aa, Artificial Sequence
  synthetic polypeptide
ARSATWHDTHLD

SEQ ID NO: 4875 - protein, 12 aa, Artificial Sequence
  synthetic polypeptide
ARSATWHDTHLD

SEQ ID NO: 4876 - protein, 12 aa, Artificial Sequence
  synthetic polypeptide
ARSATWHDTHLD

SEQ ID NO: 4877 - protein, 12 aa, Artificial Sequence
  synthetic polypeptide
ARSATWHDTHLD

SEQ ID NO: 4878 - protein, 12 aa, Artificial Sequence
  synthetic polypeptide
ARSATWHDTHLD

SEQ ID NO: 4879 - protein, 12 aa, Artificial Sequence
  synthetic polypeptide
ARSATWHDTHLD

SEQ ID NO: 4880 - protein, 12 aa, Artificial Sequence
  synthetic polypeptide
ARSATWHDTHLD

SEQ ID NO: 4881 - protein, 12 aa, Artificial Sequence
  synthetic polypeptide
ARSATWHDTHLD

SEQ ID NO: 4882 - protein, 12 aa, Artificial Sequence
  synthetic polypeptide
ARSATWHDTHLD

SEQ ID NO: 4883 - protein, 12 aa, Artificial Sequence
  synthetic polypeptide
ARSATWHDTHLD

SEQ ID NO: 4884 - protein, 12 aa, Artificial Sequence
  synthetic polypeptide
ARSATWHDTHLD

SEQ ID NO: 4885 - protein, 12 aa, Artificial Sequence
  synthetic polypeptide
ARSATWHDTHLD

SEQ ID NO: 4886 - protein, 12 aa, Artificial Sequence
  synthetic polypeptide
ARSATWHDTHLD

SEQ ID NO: 4887 - protein, 12 aa, Artificial Sequence
  synthetic polypeptide
ARSATWHDTHLD

SEQ ID NO: 4888 - protein, 12 aa, Artificial Sequence
  synthetic polypeptide
ARSATWHDTHLD

SEQ ID NO: 4889 - protein, 12 aa, Artificial Sequence
  synthetic polypeptide
ARSATWHDTHLD

SEQ ID NO: 4890 - protein, 12 aa, Artificial Sequence
  synthetic polypeptide
ARSATWHDTHLD

SEQ ID NO: 4891 - protein, 12 aa, Artificial Sequence
  synthetic polypeptide
ARSATWHDTHLD

SEQ ID NO: 4892 - protein, 12 aa, Artificial Sequence
  synthetic polypeptide
ARSATWHDTHLD

SEQ ID NO: 4893 - protein, 12 aa, Artificial Sequence
  synthetic polypeptide
ARSATWHDTHLD

SEQ ID NO: 4894 - protein, 12 aa, Artificial Sequence
  synthetic polypeptide
ARSATWHDTHLD

SEQ ID NO: 4895 - protein, 12 aa, Artificial Sequence
  synthetic polypeptide
ARSATWHDTHLD

SEQ ID NO: 4896 - protein, 12 aa, Artificial Sequence
  synthetic polypeptide
ARSATWHDTHLD

SEQ ID NO: 4897 - protein, 12 aa, Artificial Sequence
  synthetic polypeptide
ARSATWHDTHLD

SEQ ID NO: 4898 - protein, 12 aa, Artificial Sequence
  synthetic polypeptide
ARSATWHDTHLD

SEQ ID NO: 4899 - protein, 12 aa, Artificial Sequence
  synthetic polypeptide
ARSATWHDTHLD

SEQ ID NO: 4900 - protein, 12 aa, Artificial Sequence
  synthetic polypeptide
ARSATWHDTHLD

SEQ ID NO: 4901 - protein, 12 aa, Artificial Sequence
  synthetic polypeptide
ARSATWHDTHLD

SEQ ID NO: 4902 - protein, 12 aa, Artificial Sequence
  synthetic polypeptide
ARSATWHDTHLD

SEQ ID NO: 4903 - protein, 12 aa, Artificial Sequence
  synthetic polypeptide
ARSATWHDTHLD

SEQ ID NO: 4904 - protein, 12 aa, Artificial Sequence
  synthetic polypeptide
ARSATWHDTHLD

SEQ ID NO: 4905 - protein, 12 aa, Artificial Sequence
  synthetic polypeptide
ARSATWHDTHLD

SEQ ID NO: 4906 - protein, 12 aa, Artificial Sequence
  synthetic polypeptide
ARSATWHDTHLD

SEQ ID NO: 4907 - protein, 12 aa, Artificial Sequence
  synthetic polypeptide
ARSATWHDTHLD

SEQ ID NO: 4908 - protein, 12 aa, Artificial Sequence
  synthetic polypeptide
ARSATWHDTHLD

SEQ ID NO: 4909 - protein, 12 aa, Artificial Sequence
  synthetic polypeptide
ARSATWHDTHLD

SEQ ID NO: 4910 - protein, 12 aa, Artificial Sequence
  synthetic polypeptide
ARSATWHDTHLD

SEQ ID NO: 4911 - protein, 12 aa, Artificial Sequence
  synthetic polypeptide
ARSATWHDTHLD

SEQ ID NO: 4912 - protein, 12 aa, Artificial Sequence
  synthetic polypeptide
ARSATWHDTHLD

SEQ ID NO: 4913 - protein, 12 aa, Artificial Sequence
  synthetic polypeptide
ARSATWHDTHLD

SEQ ID NO: 4914 - protein, 12 aa, Artificial Sequence
  synthetic polypeptide
ARSATWHDTHLD

SEQ ID NO: 4915 - protein, 12 aa, Artificial Sequence
  synthetic polypeptide
ARSATWHDTHLD

SEQ ID NO: 4916 - protein, 12 aa, Artificial Sequence
  synthetic polypeptide
ARSATWHDTHLD

SEQ ID NO: 4917 - protein, 12 aa, Artificial Sequence
  synthetic polypeptide
ARSATWHDTHLD

SEQ ID NO: 4918 - protein, 12 aa, Artificial Sequence
  synthetic polypeptide
ARSATWHDTHLD

SEQ ID NO: 4919 - protein, 12 aa, Artificial Sequence
  synthetic polypeptide
ARSATWHDTHLD

SEQ ID NO: 4920 - protein, 12 aa, Artificial Sequence
  synthetic polypeptide
ARSATWHDTHLD

SEQ ID NO: 4921 - protein, 12 aa, Artificial Sequence
  synthetic polypeptide
ARSATWHDTHLD

SEQ ID NO: 4922 - protein, 12 aa, Artificial Sequence
  synthetic polypeptide
ARSATWHDTHLD

SEQ ID NO: 4923 - protein, 12 aa, Artificial Sequence
  synthetic polypeptide
ARSATWHDTHLD

SEQ ID NO: 4924 - protein, 12 aa, Artificial Sequence
  synthetic polypeptide
ARSATWHDTHLD

SEQ ID NO: 4925 - protein, 12 aa, Artificial Sequence
  synthetic polypeptide
ARSATWHDTHLD

SEQ ID NO: 4926 - protein, 12 aa, Artificial Sequence
  synthetic polypeptide
ARSATWHDTHLD

SEQ ID NO: 4927 - protein, 12 aa, Artificial Sequence
  synthetic polypeptide
ARSATWHDTHLD

SEQ ID NO: 4928 - protein, 12 aa, Artificial Sequence
  synthetic polypeptide
ARSATWHDTHLD

SEQ ID NO: 4929 - protein, 12 aa, Artificial Sequence
  synthetic polypeptide
ARSATWHDTHLD

SEQ ID NO: 4930 - protein, 12 aa, Artificial Sequence
  synthetic polypeptide
ARSATWHDTHLD

SEQ ID NO: 4931 - protein, 12 aa, Artificial Sequence
  synthetic polypeptide
ARSATWHDTHLD

SEQ ID NO: 4932 - protein, 12 aa, Artificial Sequence
  synthetic polypeptide
ARSATWHDTHLD

SEQ ID NO: 4933 - protein, 12 aa, Artificial Sequence
  synthetic polypeptide
ARSATWHDTHLD

SEQ ID NO: 4934 - protein, 12 aa, Artificial Sequence
  synthetic polypeptide
ARSATWHDTHLD

SEQ ID NO: 4935 - protein, 12 aa, Artificial Sequence
  synthetic polypeptide
ARSATWHDTHLD

SEQ ID NO: 4936 - protein, 12 aa, Artificial Sequence
  synthetic polypeptide
ARSATWHDTHLD

SEQ ID NO: 4937 - protein, 12 aa, Artificial Sequence
  synthetic polypeptide
ARSATWHDTHLD

SEQ ID NO: 4938 - protein, 12 aa, Artificial Sequence
  synthetic polypeptide
ARSATWHDTHLD

SEQ ID NO: 4939 - protein, 12 aa, Artificial Sequence
  synthetic polypeptide
ARSATWHDTHLD

SEQ ID NO: 4940 - protein, 12 aa, Artificial Sequence
  synthetic polypeptide
ARSATWHDTHLD

SEQ ID NO: 4941 - protein, 12 aa, Artificial Sequence
  synthetic polypeptide
ARSATWHDTHLD

SEQ ID NO: 4942 - protein, 12 aa, Artificial Sequence
  synthetic polypeptide
ARSATWHDTHLD

SEQ ID NO: 4943 - protein, 12 aa, Artificial Sequence
  synthetic polypeptide
ARSATWHDTHLD

SEQ ID NO: 4944 - protein, 12 aa, Artificial Sequence
  synthetic polypeptide
ARSATWHDTHLD

SEQ ID NO: 4945 - protein, 12 aa, Artificial Sequence
  synthetic polypeptide
ARSATWHDTHLD

SEQ ID NO: 4946 - protein, 12 aa, Artificial Sequence
  synthetic polypeptide
ARSATWHDTHLD

SEQ ID NO: 4947 - protein, 12 aa, Artificial Sequence
  synthetic polypeptide
ARSATWHDTHLD

SEQ ID NO: 4948 - protein, 12 aa, Artificial Sequence
  synthetic polypeptide
ARSATWHDTHLD

SEQ ID NO: 4949 - protein, 12 aa, Artificial Sequence
  synthetic polypeptide
ARSATWHDTHLD

SEQ ID NO: 4950 - protein, 12 aa, Artificial Sequence
  synthetic polypeptide
ARSATWHDTHLD

SEQ ID NO: 4951 - protein, 12 aa, Artificial Sequence
  synthetic polypeptide
ARSATWHDTHLD

SEQ ID NO: 4952 - protein, 12 aa, Artificial Sequence
  synthetic polypeptide
ARSATWHDTHLD

SEQ ID NO: 4953 - protein, 12 aa, Artificial Sequence
  synthetic polypeptide
ARSATWHDTHLD

SEQ ID NO: 4954 - protein, 12 aa, Artificial Sequence
  synthetic polypeptide
ARSATWHDTHLD

SEQ ID NO: 4955 - protein, 12 aa, Artificial Sequence
  synthetic polypeptide
ARSATWHDTHLD

SEQ ID NO: 4956 - protein, 12 aa, Artificial Sequence
  synthetic polypeptide
ARSATWHDTHLD

SEQ ID NO: 4957 - protein, 7 aa, Artificial Sequence
  synthetic polypeptide
ISYLNWY

SEQ ID NO: 4958 - protein, 7 aa, Artificial Sequence
  synthetic polypeptide
ITYLNWY

SEQ ID NO: 4959 - protein, 7 aa, Artificial Sequence
  synthetic polypeptide
ITYLNWY

SEQ ID NO: 4960 - protein, 7 aa, Artificial Sequence
  synthetic polypeptide
LSYLNWY

SEQ ID NO: 4961 - protein, 7 aa, Artificial Sequence
  synthetic polypeptide
LSYLNWY

SEQ ID NO: 4962 - protein, 7 aa, Artificial Sequence
  synthetic polypeptide
LSYVNWY

SEQ ID NO: 4963 - protein, 7 aa, Artificial Sequence
  synthetic polypeptide
LSYVNWY

SEQ ID NO: 4964 - protein, 7 aa, Artificial Sequence
  synthetic polypeptide
LSYVNWY

SEQ ID NO: 4965 - protein, 7 aa, Artificial Sequence
  synthetic polypeptide
LTYVNWY

SEQ ID NO: 4966 - protein, 7 aa, Artificial Sequence
  synthetic polypeptide
VTYLNWY

SEQ ID NO: 4967 - protein, 7 aa, Artificial Sequence
  synthetic polypeptide
LSYVNWY

SEQ ID NO: 4968 - protein, 7 aa, Artificial Sequence
  synthetic polypeptide
VSYVNWY

SEQ ID NO: 4969 - protein, 7 aa, Artificial Sequence
  synthetic polypeptide
LSYVNWY

SEQ ID NO: 4970 - protein, 7 aa, Artificial Sequence
  synthetic polypeptide
LSYLNWY

SEQ ID NO: 4971 - protein, 7 aa, Artificial Sequence
  synthetic polypeptide
LSYLNWY

SEQ ID NO: 4972 - protein, 7 aa, Artificial Sequence
  synthetic polypeptide
LSYVNWY

SEQ ID NO: 4973 - protein, 7 aa, Artificial Sequence
  synthetic polypeptide
LSYVNWY

SEQ ID NO: 4974 - protein, 7 aa, Artificial Sequence
  synthetic polypeptide
LSYVNWY

SEQ ID NO: 4975 - protein, 7 aa, Artificial Sequence
  synthetic polypeptide
LTYVNWY

SEQ ID NO: 4976 - protein, 7 aa, Artificial Sequence
  synthetic polypeptide
ISYVNWY

SEQ ID NO: 4977 - protein, 7 aa, Artificial Sequence
  synthetic polypeptide
LSYVNWY

SEQ ID NO: 4978 - protein, 7 aa, Artificial Sequence
  synthetic polypeptide
SSYLNWY

SEQ ID NO: 4979 - protein, 7 aa, Artificial Sequence
  synthetic polypeptide
LSYLNWY

SEQ ID NO: 4980 - protein, 7 aa, Artificial Sequence
  synthetic polypeptide
ITYLNWY

SEQ ID NO: 4981 - protein, 7 aa, Artificial Sequence
  synthetic polypeptide
SSYLNWY

SEQ ID NO: 4982 - protein, 7 aa, Artificial Sequence
  synthetic polypeptide
VTYVNWY

SEQ ID NO: 4983 - protein, 7 aa, Artificial Sequence
  synthetic polypeptide
LTYLNWY

SEQ ID NO: 4984 - protein, 7 aa, Artificial Sequence
  synthetic polypeptide
VSYLNWY

SEQ ID NO: 4985 - protein, 7 aa, Artificial Sequence
  synthetic polypeptide
LTYVNWY

SEQ ID NO: 4986 - protein, 7 aa, Artificial Sequence
  synthetic polypeptide
LSYVNWY

SEQ ID NO: 4987 - protein, 7 aa, Artificial Sequence
  synthetic polypeptide
LSYVNWY

SEQ ID NO: 4988 - protein, 7 aa, Artificial Sequence
  synthetic polypeptide
ISYVNWY

SEQ ID NO: 4989 - protein, 7 aa, Artificial Sequence
  synthetic polypeptide
LTYVNWY

SEQ ID NO: 4990 - protein, 7 aa, Artificial Sequence
  synthetic polypeptide
LTYVNWY

SEQ ID NO: 4991 - protein, 7 aa, Artificial Sequence
  synthetic polypeptide
LTYVNWY

SEQ ID NO: 4992 - protein, 7 aa, Artificial Sequence
  synthetic polypeptide
LTYVNWY

SEQ ID NO: 4993 - protein, 7 aa, Artificial Sequence
  synthetic polypeptide
LTYVNWY

SEQ ID NO: 4994 - protein, 7 aa, Artificial Sequence
  synthetic polypeptide
ISYVNWY

SEQ ID NO: 4995 - protein, 7 aa, Artificial Sequence
  synthetic polypeptide
LTYVNWY

SEQ ID NO: 4996 - protein, 7 aa, Artificial Sequence
  synthetic polypeptide
LSYLNWY

SEQ ID NO: 4997 - protein, 7 aa, Artificial Sequence
  synthetic polypeptide
LTYLNWY

SEQ ID NO: 4998 - protein, 7 aa, Artificial Sequence
  synthetic polypeptide
LTYLNWY

SEQ ID NO: 4999 - protein, 7 aa, Artificial Sequence
  synthetic polypeptide
SSYLNWY

SEQ ID NO: 5000 - protein, 7 aa, Artificial Sequence
  synthetic polypeptide
VSYLNWY

SEQ ID NO: 5001 - protein, 7 aa, Artificial Sequence
  synthetic polypeptide
LTYLNWY

SEQ ID NO: 5002 - protein, 7 aa, Artificial Sequence
  synthetic polypeptide
LTYLNWY

SEQ ID NO: 5003 - protein, 7 aa, Artificial Sequence
  synthetic polypeptide
LTYVNWY

SEQ ID NO: 5004 - protein, 7 aa, Artificial Sequence
  synthetic polypeptide
LRYLNWY

SEQ ID NO: 5005 - protein, 7 aa, Artificial Sequence
  synthetic polypeptide
LRYLNWY

SEQ ID NO: 5006 - protein, 7 aa, Artificial Sequence
  synthetic polypeptide
IRYLNWY

SEQ ID NO: 5007 - protein, 7 aa, Artificial Sequence
  synthetic polypeptide
LTYLNWY

SEQ ID NO: 5008 - protein, 7 aa, Artificial Sequence
  synthetic polypeptide
LTYLNWY

SEQ ID NO: 5009 - protein, 7 aa, Artificial Sequence
  synthetic polypeptide
LSYLNWY

SEQ ID NO: 5010 - protein, 7 aa, Artificial Sequence
  synthetic polypeptide
LTYLNWY

SEQ ID NO: 5011 - protein, 7 aa, Artificial Sequence
  synthetic polypeptide
LTYLNWY

SEQ ID NO: 5012 - protein, 7 aa, Artificial Sequence
  synthetic polypeptide
LSYLNWY

SEQ ID NO: 5013 - protein, 7 aa, Artificial Sequence
  synthetic polypeptide
LSYLNWY

SEQ ID NO: 5014 - protein, 7 aa, Artificial Sequence
  synthetic polypeptide
LTYVNWY

SEQ ID NO: 5015 - protein, 7 aa, Artificial Sequence
  synthetic polypeptide
LSYLNWY

SEQ ID NO: 5016 - protein, 7 aa, Artificial Sequence
  synthetic polypeptide
STYVNWY

SEQ ID NO: 5017 - protein, 7 aa, Artificial Sequence
  synthetic polypeptide
LTYLNWY

SEQ ID NO: 5018 - protein, 7 aa, Artificial Sequence
  synthetic polypeptide
SSYLNWY

SEQ ID NO: 5019 - protein, 7 aa, Artificial Sequence
  synthetic polypeptide
VTYVNWY

SEQ ID NO: 5020 - protein, 7 aa, Artificial Sequence
  synthetic polypeptide
LTYLNWY

SEQ ID NO: 5021 - protein, 7 aa, Artificial Sequence
  synthetic polypeptide
LTYLNWY

SEQ ID NO: 5022 - protein, 7 aa, Artificial Sequence
  synthetic polypeptide
LTYVNWY

SEQ ID NO: 5023 - protein, 7 aa, Artificial Sequence
  synthetic polypeptide
VSYLNWY

SEQ ID NO: 5024 - protein, 7 aa, Artificial Sequence
  synthetic polypeptide
LTYLNWY

SEQ ID NO: 5025 - protein, 7 aa, Artificial Sequence
  synthetic polypeptide
LSYVNWY

SEQ ID NO: 5026 - protein, 7 aa, Artificial Sequence
  synthetic polypeptide
VSYLNWY

SEQ ID NO: 5027 - protein, 7 aa, Artificial Sequence
  synthetic polypeptide
ISYVNWY

SEQ ID NO: 5028 - protein, 7 aa, Artificial Sequence
  synthetic polypeptide
ISYVNWY

SEQ ID NO: 5029 - protein, 7 aa, Artificial Sequence
  synthetic polypeptide
LTYLNWY

SEQ ID NO: 5030 - protein, 7 aa, Artificial Sequence
  synthetic polypeptide
LSYVNWY

SEQ ID NO: 5031 - protein, 7 aa, Artificial Sequence
  synthetic polypeptide
LSYLNWY

SEQ ID NO: 5032 - protein, 7 aa, Artificial Sequence
  synthetic polypeptide
LTYVNWY

SEQ ID NO: 5033 - protein, 7 aa, Artificial Sequence
  synthetic polypeptide
LTYLNWY

SEQ ID NO: 5034 - protein, 7 aa, Artificial Sequence
  synthetic polypeptide
VTYLNWY

SEQ ID NO: 5035 - protein, 7 aa, Artificial Sequence
  synthetic polypeptide
LTYLNWY

SEQ ID NO: 5036 - protein, 7 aa, Artificial Sequence
  synthetic polypeptide
LSYVNWY

SEQ ID NO: 5037 - protein, 7 aa, Artificial Sequence
  synthetic polypeptide
LTYLNWY

SEQ ID NO: 5038 - protein, 7 aa, Artificial Sequence
  synthetic polypeptide
LTYLNWY

SEQ ID NO: 5039 - protein, 7 aa, Artificial Sequence
  synthetic polypeptide
LTYLNWY

SEQ ID NO: 5040 - protein, 7 aa, Artificial Sequence
  synthetic polypeptide
LTYVNWY

SEQ ID NO: 5041 - protein, 7 aa, Artificial Sequence
  synthetic polypeptide
LSYVNWY

SEQ ID NO: 5042 - protein, 7 aa, Artificial Sequence
  synthetic polypeptide
VTYLNWY

SEQ ID NO: 5043 - protein, 7 aa, Artificial Sequence
  synthetic polypeptide
VTYLNWY

SEQ ID NO: 5044 - protein, 7 aa, Artificial Sequence
  synthetic polypeptide
VTYLNWY

SEQ ID NO: 5045 - protein, 7 aa, Artificial Sequence
  synthetic polypeptide
ISYLNWY

SEQ ID NO: 5046 - protein, 7 aa, Artificial Sequence
  synthetic polypeptide
LTYLNWY

SEQ ID NO: 5047 - protein, 7 aa, Artificial Sequence
  synthetic polypeptide
LSYLNWY

SEQ ID NO: 5048 - protein, 7 aa, Artificial Sequence
  synthetic polypeptide
LSYLNWY

SEQ ID NO: 5049 - protein, 7 aa, Artificial Sequence
  synthetic polypeptide
VRYLNWY

SEQ ID NO: 5050 - protein, 7 aa, Artificial Sequence
  synthetic polypeptide
VTYLNWY

SEQ ID NO: 5051 - protein, 7 aa, Artificial Sequence
  synthetic polypeptide
LTYVNWY

SEQ ID NO: 5052 - protein, 7 aa, Artificial Sequence
  synthetic polypeptide
LTYVNWY

SEQ ID NO: 5053 - protein, 7 aa, Artificial Sequence
  synthetic polypeptide
LSYLNWY

SEQ ID NO: 5054 - protein, 7 aa, Artificial Sequence
  synthetic polypeptide
VSYVNWY

SEQ ID NO: 5055 - protein, 7 aa, Artificial Sequence
  synthetic polypeptide
VRYLNWY

SEQ ID NO: 5056 - protein, 7 aa, Artificial Sequence
  synthetic polypeptide
VSYVNWY

SEQ ID NO: 5057 - protein, 7 aa, Artificial Sequence
  synthetic polypeptide
LSYLNWY

SEQ ID NO: 5058 - protein, 7 aa, Artificial Sequence
  synthetic polypeptide
LSYLNWY

SEQ ID NO: 5059 - protein, 7 aa, Artificial Sequence
  synthetic polypeptide
LTYLNWY

SEQ ID NO: 5060 - protein, 7 aa, Artificial Sequence
  synthetic polypeptide
LTYVNWY

SEQ ID NO: 5061 - protein, 7 aa, Artificial Sequence
  synthetic polypeptide
LSYVNWY

SEQ ID NO: 5062 - protein, 7 aa, Artificial Sequence
  synthetic polypeptide
ISYVNWY

SEQ ID NO: 5063 - protein, 7 aa, Artificial Sequence
  synthetic polypeptide
LTYVNWY

SEQ ID NO: 5064 - protein, 7 aa, Artificial Sequence
  synthetic polypeptide
LTYLNWY

SEQ ID NO: 5065 - protein, 7 aa, Artificial Sequence
  synthetic polypeptide
LSYVNWY

SEQ ID NO: 5066 - protein, 7 aa, Artificial Sequence
  synthetic polypeptide
SSYLNWY

SEQ ID NO: 5067 - protein, 7 aa, Artificial Sequence
  synthetic polypeptide
LSYVNWY

SEQ ID NO: 5068 - protein, 7 aa, Artificial Sequence
  synthetic polypeptide
LTYLNWY

SEQ ID NO: 5069 - protein, 7 aa, Artificial Sequence
  synthetic polypeptide
LTYLNWY

SEQ ID NO: 5070 - protein, 7 aa, Artificial Sequence
  synthetic polypeptide
LTYVNWY

SEQ ID NO: 5071 - protein, 7 aa, Artificial Sequence
  synthetic polypeptide
LSYVNWY

SEQ ID NO: 5072 - protein, 7 aa, Artificial Sequence
  synthetic polypeptide
LTYVNWY

SEQ ID NO: 5073 - protein, 7 aa, Artificial Sequence
  synthetic polypeptide
VTYVNWY

SEQ ID NO: 5074 - protein, 7 aa, Artificial Sequence
  synthetic polypeptide
LSYLNWY

SEQ ID NO: 5075 - protein, 7 aa, Artificial Sequence
  synthetic polypeptide
VSYVNWY

SEQ ID NO: 5076 - protein, 7 aa, Artificial Sequence
  synthetic polypeptide
LSYLNWY

SEQ ID NO: 5077 - protein, 7 aa, Artificial Sequence
  synthetic polypeptide
ISYVNWY

SEQ ID NO: 5078 - protein, 7 aa, Artificial Sequence
  synthetic polypeptide
LTYLNWY

SEQ ID NO: 5079 - protein, 7 aa, Artificial Sequence
  synthetic polypeptide
LTYLNWY

SEQ ID NO: 5080 - protein, 7 aa, Artificial Sequence
  synthetic polypeptide
VSYVNWY

SEQ ID NO: 5081 - protein, 7 aa, Artificial Sequence
  synthetic polypeptide
LTYLNWY

SEQ ID NO: 5082 - protein, 7 aa, Artificial Sequence
  synthetic polypeptide
LTYLNWY

SEQ ID NO: 5083 - protein, 7 aa, Artificial Sequence
  synthetic polypeptide
LSYLNWY

SEQ ID NO: 5084 - protein, 7 aa, Artificial Sequence
  synthetic polypeptide
ITYVNWY

SEQ ID NO: 5085 - protein, 7 aa, Artificial Sequence
  synthetic polypeptide
LTYLNWY

SEQ ID NO: 5086 - protein, 7 aa, Artificial Sequence
  synthetic polypeptide
ISYLNWY

SEQ ID NO: 5087 - protein, 7 aa, Artificial Sequence
  synthetic polypeptide
LSYLNWY

SEQ ID NO: 5088 - protein, 7 aa, Artificial Sequence
  synthetic polypeptide
VSYLNWY

SEQ ID NO: 5089 - protein, 7 aa, Artificial Sequence
  synthetic polypeptide
LTYVNWY

SEQ ID NO: 5090 - protein, 7 aa, Artificial Sequence
  synthetic polypeptide
VSYVNWY

SEQ ID NO: 5091 - protein, 7 aa, Artificial Sequence
  synthetic polypeptide
VTYLNWY

SEQ ID NO: 5092 - protein, 7 aa, Artificial Sequence
  synthetic polypeptide
LSYVNWY

SEQ ID NO: 5093 - protein, 7 aa, Artificial Sequence
  synthetic polypeptide
LTYLNWY

SEQ ID NO: 5094 - protein, 7 aa, Artificial Sequence
  synthetic polypeptide
LTYVNWY

SEQ ID NO: 5095 - protein, 7 aa, Artificial Sequence
  synthetic polypeptide
VTYVNWY

SEQ ID NO: 5096 - protein, 7 aa, Artificial Sequence
  synthetic polypeptide
ISYLNWY

SEQ ID NO: 5097 - protein, 7 aa, Artificial Sequence
  synthetic polypeptide
LTYLNWY

SEQ ID NO: 5098 - protein, 7 aa, Artificial Sequence
  synthetic polypeptide
LTYVNWY

SEQ ID NO: 5099 - protein, 7 aa, Artificial Sequence
  synthetic polypeptide
LTYVNWY

SEQ ID NO: 5100 - protein, 7 aa, Artificial Sequence
  synthetic polypeptide
LTYVNWY

SEQ ID NO: 5101 - protein, 7 aa, Artificial Sequence
  synthetic polypeptide
SSYLNWY

SEQ ID NO: 5102 - protein, 7 aa, Artificial Sequence
  synthetic polypeptide
LSYLNWY

SEQ ID NO: 5103 - protein, 7 aa, Artificial Sequence
  synthetic polypeptide
VTYLNWY

SEQ ID NO: 5104 - protein, 7 aa, Artificial Sequence
  synthetic polypeptide
LSYLNWY

SEQ ID NO: 5105 - protein, 7 aa, Artificial Sequence
  synthetic polypeptide
LTYVNWY

SEQ ID NO: 5106 - protein, 7 aa, Artificial Sequence
  synthetic polypeptide
LTYLNWY

SEQ ID NO: 5107 - protein, 7 aa, Artificial Sequence
  synthetic polypeptide
LSYVNWY

SEQ ID NO: 5108 - protein, 7 aa, Artificial Sequence
  synthetic polypeptide
VTYLNWY

SEQ ID NO: 5109 - protein, 7 aa, Artificial Sequence
  synthetic polypeptide
LTYVNWY

SEQ ID NO: 5110 - protein, 7 aa, Artificial Sequence
  synthetic polypeptide
LTYVNWY

SEQ ID NO: 5111 - protein, 7 aa, Artificial Sequence
  synthetic polypeptide
VTYLNWY

SEQ ID NO: 5112 - protein, 7 aa, Artificial Sequence
  synthetic polypeptide
LSYLNWY

SEQ ID NO: 5113 - protein, 7 aa, Artificial Sequence
  synthetic polypeptide
VSYVNWY

SEQ ID NO: 5114 - protein, 7 aa, Artificial Sequence
  synthetic polypeptide
STYLNWY

SEQ ID NO: 5115 - protein, 7 aa, Artificial Sequence
  synthetic polypeptide
VSYVNWY

SEQ ID NO: 5116 - protein, 7 aa, Artificial Sequence
  synthetic polypeptide
LTYVNWY

SEQ ID NO: 5117 - protein, 7 aa, Artificial Sequence
  synthetic polypeptide
LSYLNWY

SEQ ID NO: 5118 - protein, 7 aa, Artificial Sequence
  synthetic polypeptide
LSYVNWY

SEQ ID NO: 5119 - protein, 7 aa, Artificial Sequence
  synthetic polypeptide
VSYVNWY

SEQ ID NO: 5120 - protein, 7 aa, Artificial Sequence
  synthetic polypeptide
VSYVNWY

SEQ ID NO: 5121 - protein, 7 aa, Artificial Sequence
  synthetic polypeptide
SSYLNWY

SEQ ID NO: 5122 - protein, 7 aa, Artificial Sequence
  synthetic polypeptide
VTYLNWY

SEQ ID NO: 5123 - protein, 7 aa, Artificial Sequence
  synthetic polypeptide
SSYLNWY

SEQ ID NO: 5124 - protein, 7 aa, Artificial Sequence
  synthetic polypeptide
VSYLNWY

SEQ ID NO: 5125 - protein, 7 aa, Artificial Sequence
  synthetic polypeptide
SSYVNWY

SEQ ID NO: 5126 - protein, 10 aa, Artificial Sequence
  synthetic polypeptide
LLIYAATSRA

SEQ ID NO: 5127 - protein, 10 aa, Artificial Sequence
  synthetic polypeptide
LLIYAATSLA

SEQ ID NO: 5128 - protein, 10 aa, Artificial Sequence
  synthetic polypeptide
LLIYAATSRA

SEQ ID NO: 5129 - protein, 10 aa, Artificial Sequence
  synthetic polypeptide
LVIYAATSRA

SEQ ID NO: 5130 - protein, 10 aa, Artificial Sequence
  synthetic polypeptide
LVIYAATSRA

SEQ ID NO: 5131 - protein, 10 aa, Artificial Sequence
  synthetic polypeptide
LVIYAATSRA

SEQ ID NO: 5132 - protein, 10 aa, Artificial Sequence
  synthetic polypeptide
LVIYATTSRA

SEQ ID NO: 5133 - protein, 10 aa, Artificial Sequence
  synthetic polypeptide
LVIYATTSRA

SEQ ID NO: 5134 - protein, 10 aa, Artificial Sequence
  synthetic polypeptide
LVIYAATSLA

SEQ ID NO: 5135 - protein, 10 aa, Artificial Sequence
  synthetic polypeptide
LLIYAATSLH

SEQ ID NO: 5136 - protein, 10 aa, Artificial Sequence
  synthetic polypeptide
LLIYAATSRA

SEQ ID NO: 5137 - protein, 10 aa, Artificial Sequence
  synthetic polypeptide
LLIYAATSRA

SEQ ID NO: 5138 - protein, 10 aa, Artificial Sequence
  synthetic polypeptide
LLIYAVTSRA

SEQ ID NO: 5139 - protein, 10 aa, Artificial Sequence
  synthetic polypeptide
LVIYYVSNRA

SEQ ID NO: 5140 - protein, 10 aa, Artificial Sequence
  synthetic polypeptide
LVIYYVSNRA

SEQ ID NO: 5141 - protein, 10 aa, Artificial Sequence
  synthetic polypeptide
LVIYAATSRA

SEQ ID NO: 5142 - protein, 10 aa, Artificial Sequence
  synthetic polypeptide
LVIYAATSRA

SEQ ID NO: 5143 - protein, 10 aa, Artificial Sequence
  synthetic polypeptide
LVIYAATSRA

SEQ ID NO: 5144 - protein, 10 aa, Artificial Sequence
  synthetic polypeptide
LVIYAATSRH

SEQ ID NO: 5145 - protein, 10 aa, Artificial Sequence
  synthetic polypeptide
LLIYAASSLQ

SEQ ID NO: 5146 - protein, 10 aa, Artificial Sequence
  synthetic polypeptide
LVIYAATSRA

SEQ ID NO: 5147 - protein, 10 aa, Artificial Sequence
  synthetic polypeptide
LLIYAASSLQ

SEQ ID NO: 5148 - protein, 10 aa, Artificial Sequence
  synthetic polypeptide
LLIYAASSLQ

SEQ ID NO: 5149 - protein, 10 aa, Artificial Sequence
  synthetic polypeptide
LLIYAASSLQ

SEQ ID NO: 5150 - protein, 10 aa, Artificial Sequence
  synthetic polypeptide
LLIYAASSLQ

SEQ ID NO: 5151 - protein, 10 aa, Artificial Sequence
  synthetic polypeptide
LLIYAATSRA

SEQ ID NO: 5152 - protein, 10 aa, Artificial Sequence
  synthetic polypeptide
LVIYAATSRA

SEQ ID NO: 5153 - protein, 10 aa, Artificial Sequence
  synthetic polypeptide
LLIYAATSRA

SEQ ID NO: 5154 - protein, 10 aa, Artificial Sequence
  synthetic polypeptide
LVIYAATSRA

SEQ ID NO: 5155 - protein, 10 aa, Artificial Sequence
  synthetic polypeptide
LLIYAATSRA

SEQ ID NO: 5156 - protein, 10 aa, Artificial Sequence
  synthetic polypeptide
LVIYAATSRH

SEQ ID NO: 5157 - protein, 10 aa, Artificial Sequence
  synthetic polypeptide
LLIYAATSRH

SEQ ID NO: 5158 - protein, 10 aa, Artificial Sequence
  synthetic polypeptide
LVIYAATSRA

SEQ ID NO: 5159 - protein, 10 aa, Artificial Sequence
  synthetic polypeptide
LLIYAATSRA

SEQ ID NO: 5160 - protein, 10 aa, Artificial Sequence
  synthetic polypeptide
LLIYAATSRA

SEQ ID NO: 5161 - protein, 10 aa, Artificial Sequence
  synthetic polypeptide
LLIYAATSLH

SEQ ID NO: 5162 - protein, 10 aa, Artificial Sequence
  synthetic polypeptide
LVIYATTSLA

SEQ ID NO: 5163 - protein, 10 aa, Artificial Sequence
  synthetic polypeptide
LLIYAATSLA

SEQ ID NO: 5164 - protein, 10 aa, Artificial Sequence
  synthetic polypeptide
LVIYAATSRA

SEQ ID NO: 5165 - protein, 10 aa, Artificial Sequence
  synthetic polypeptide
LLIYAATSLA

SEQ ID NO: 5166 - protein, 10 aa, Artificial Sequence
  synthetic polypeptide
LVIYAATSRA

SEQ ID NO: 5167 - protein, 10 aa, Artificial Sequence
  synthetic polypeptide
LLIYAATSLA

SEQ ID NO: 5168 - protein, 10 aa, Artificial Sequence
  synthetic polypeptide
LLIYAATSLA

SEQ ID NO: 5169 - protein, 10 aa, Artificial Sequence
  synthetic polypeptide
LLIYAATSRA

SEQ ID NO: 5170 - protein, 10 aa, Artificial Sequence
  synthetic polypeptide
LLIYAATSRA

SEQ ID NO: 5171 - protein, 10 aa, Artificial Sequence
  synthetic polypeptide
LLIYAATSRA

SEQ ID NO: 5172 - protein, 10 aa, Artificial Sequence
  synthetic polypeptide
LLIYAASSLQ

SEQ ID NO: 5173 - protein, 10 aa, Artificial Sequence
  synthetic polypeptide
LLIYAATSLH

SEQ ID NO: 5174 - protein, 10 aa, Artificial Sequence
  synthetic polypeptide
LLIYAATSLH

SEQ ID NO: 5175 - protein, 10 aa, Artificial Sequence
  synthetic polypeptide
LVIYAATSRA

SEQ ID NO: 5176 - protein, 10 aa, Artificial Sequence
  synthetic polypeptide
LVIYAATSRA

SEQ ID NO: 5177 - protein, 10 aa, Artificial Sequence
  synthetic polypeptide
LVIYAATSRA

SEQ ID NO: 5178 - protein, 10 aa, Artificial Sequence
  synthetic polypeptide
LLIYATTSLA

SEQ ID NO: 5179 - protein, 10 aa, Artificial Sequence
  synthetic polypeptide
LVIYAATSLA

SEQ ID NO: 5180 - protein, 10 aa, Artificial Sequence
  synthetic polypeptide
LLIYAASSLQ

SEQ ID NO: 5181 - protein, 10 aa, Artificial Sequence
  synthetic polypeptide
LLIYAATSRH

SEQ ID NO: 5182 - protein, 10 aa, Artificial Sequence
  synthetic polypeptide
LLIYAATSRA

SEQ ID NO: 5183 - protein, 10 aa, Artificial Sequence
  synthetic polypeptide
LVIYAATSLA

SEQ ID NO: 5184 - protein, 10 aa, Artificial Sequence
  synthetic polypeptide
LVIYAATSLA

SEQ ID NO: 5185 - protein, 10 aa, Artificial Sequence
  synthetic polypeptide
LLIYAVTSLA

SEQ ID NO: 5186 - protein, 10 aa, Artificial Sequence
  synthetic polypeptide
LVIYAVTSLA

SEQ ID NO: 5187 - protein, 10 aa, Artificial Sequence
  synthetic polypeptide
LLIYAASSLQ

SEQ ID NO: 5188 - protein, 10 aa, Artificial Sequence
  synthetic polypeptide
LVIYAATSLA

SEQ ID NO: 5189 - protein, 10 aa, Artificial Sequence
  synthetic polypeptide
LLIYAATSRA

SEQ ID NO: 5190 - protein, 10 aa, Artificial Sequence
  synthetic polypeptide
LLIYAATSRA

SEQ ID NO: 5191 - protein, 10 aa, Artificial Sequence
  synthetic polypeptide
LLIYAATSRA

SEQ ID NO: 5192 - protein, 10 aa, Artificial Sequence
  synthetic polypeptide
LLIYAATSRA

SEQ ID NO: 5193 - protein, 10 aa, Artificial Sequence
  synthetic polypeptide
LLIYAATSRA

SEQ ID NO: 5194 - protein, 10 aa, Artificial Sequence
  synthetic polypeptide
LLIYAATSRH

SEQ ID NO: 5195 - protein, 10 aa, Artificial Sequence
  synthetic polypeptide
LVIYAATSRA

SEQ ID NO: 5196 - protein, 10 aa, Artificial Sequence
  synthetic polypeptide
LLIYAATSRH

SEQ ID NO: 5197 - protein, 10 aa, Artificial Sequence
  synthetic polypeptide
LLIYAATSRH

SEQ ID NO: 5198 - protein, 10 aa, Artificial Sequence
  synthetic polypeptide
LVIYAATSLA

SEQ ID NO: 5199 - protein, 10 aa, Artificial Sequence
  synthetic polypeptide
LVIYAATSRA

SEQ ID NO: 5200 - protein, 10 aa, Artificial Sequence
  synthetic polypeptide
LLIYAATSRA

SEQ ID NO: 5201 - protein, 10 aa, Artificial Sequence
  synthetic polypeptide
LLIYAATSRH

SEQ ID NO: 5202 - protein, 10 aa, Artificial Sequence
  synthetic polypeptide
LLIYAATSLH

SEQ ID NO: 5203 - protein, 10 aa, Artificial Sequence
  synthetic polypeptide
LLIYAATSPA

SEQ ID NO: 5204 - protein, 10 aa, Artificial Sequence
  synthetic polypeptide
LLIYAATSRA

SEQ ID NO: 5205 - protein, 10 aa, Artificial Sequence
  synthetic polypeptide
LLIYAATSLA

SEQ ID NO: 5206 - protein, 10 aa, Artificial Sequence
  synthetic polypeptide
LLIYAATSRA

SEQ ID NO: 5207 - protein, 10 aa, Artificial Sequence
  synthetic polypeptide
LLIYAATSLA

SEQ ID NO: 5208 - protein, 10 aa, Artificial Sequence
  synthetic polypeptide
LVIYAATSLA

SEQ ID NO: 5209 - protein, 10 aa, Artificial Sequence
  synthetic polypeptide
LVIYAATSRA

SEQ ID NO: 5210 - protein, 10 aa, Artificial Sequence
  synthetic polypeptide
LLIYATTSLA

SEQ ID NO: 5211 - protein, 10 aa, Artificial Sequence
  synthetic polypeptide
LLIYAATSRA

SEQ ID NO: 5212 - protein, 10 aa, Artificial Sequence
  synthetic polypeptide
LVIYAATSLA

SEQ ID NO: 5213 - protein, 10 aa, Artificial Sequence
  synthetic polypeptide
LVIYAATSLA

SEQ ID NO: 5214 - protein, 10 aa, Artificial Sequence
  synthetic polypeptide
LLIYAVTSLA

SEQ ID NO: 5215 - protein, 10 aa, Artificial Sequence
  synthetic polypeptide
LLIYAATSRH

SEQ ID NO: 5216 - protein, 10 aa, Artificial Sequence
  synthetic polypeptide
LLIYAATSRA

SEQ ID NO: 5217 - protein, 10 aa, Artificial Sequence
  synthetic polypeptide
LLIYAASSLQ

SEQ ID NO: 5218 - protein, 10 aa, Artificial Sequence
  synthetic polypeptide
LLIYAASSLQ

SEQ ID NO: 5219 - protein, 10 aa, Artificial Sequence
  synthetic polypeptide
LVIYAATSRA

SEQ ID NO: 5220 - protein, 10 aa, Artificial Sequence
  synthetic polypeptide
LLIYAASSLQ

SEQ ID NO: 5221 - protein, 10 aa, Artificial Sequence
  synthetic polypeptide
LLIYATTSLA

SEQ ID NO: 5222 - protein, 10 aa, Artificial Sequence
  synthetic polypeptide
LVIYAATSRA

SEQ ID NO: 5223 - protein, 10 aa, Artificial Sequence
  synthetic polypeptide
LLIYAATSRA

SEQ ID NO: 5224 - protein, 10 aa, Artificial Sequence
  synthetic polypeptide
LVIYAATSLA

SEQ ID NO: 5225 - protein, 10 aa, Artificial Sequence
  synthetic polypeptide
LVIYAATSRA

SEQ ID NO: 5226 - protein, 10 aa, Artificial Sequence
  synthetic polypeptide
LLIYAATSRH

SEQ ID NO: 5227 - protein, 10 aa, Artificial Sequence
  synthetic polypeptide
LLIYAATSLH

SEQ ID NO: 5228 - protein, 10 aa, Artificial Sequence
  synthetic polypeptide
LLIYAATSRA

SEQ ID NO: 5229 - protein, 10 aa, Artificial Sequence
  synthetic polypeptide
LVIYAAPSLA

SEQ ID NO: 5230 - protein, 10 aa, Artificial Sequence
  synthetic polypeptide
LVIYATTSLA

SEQ ID NO: 5231 - protein, 10 aa, Artificial Sequence
  synthetic polypeptide
LLIYAATSRH

SEQ ID NO: 5232 - protein, 10 aa, Artificial Sequence
  synthetic polypeptide
LVIYAATSLA

SEQ ID NO: 5233 - protein, 10 aa, Artificial Sequence
  synthetic polypeptide
LLIYAATSRA

SEQ ID NO: 5234 - protein, 10 aa, Artificial Sequence
  synthetic polypeptide
LLIYAATSRH

SEQ ID NO: 5235 - protein, 10 aa, Artificial Sequence
  synthetic polypeptide
LLIYAASSLQ

SEQ ID NO: 5236 - protein, 10 aa, Artificial Sequence
  synthetic polypeptide
LVIYAVTSRA

SEQ ID NO: 5237 - protein, 10 aa, Artificial Sequence
  synthetic polypeptide
LLIYAATSRA

SEQ ID NO: 5238 - protein, 10 aa, Artificial Sequence
  synthetic polypeptide
LLIYAATSRH

SEQ ID NO: 5239 - protein, 10 aa, Artificial Sequence
  synthetic polypeptide
LVIYAATSRA

SEQ ID NO: 5240 - protein, 10 aa, Artificial Sequence
  synthetic polypeptide
LVIYAATSRA

SEQ ID NO: 5241 - protein, 10 aa, Artificial Sequence
  synthetic polypeptide
LVIYAATSRA

SEQ ID NO: 5242 - protein, 10 aa, Artificial Sequence
  synthetic polypeptide
LVIYAATSLA

SEQ ID NO: 5243 - protein, 10 aa, Artificial Sequence
  synthetic polypeptide
LLIYAVTSRA

SEQ ID NO: 5244 - protein, 10 aa, Artificial Sequence
  synthetic polypeptide
LLIYAVTSRA

SEQ ID NO: 5245 - protein, 10 aa, Artificial Sequence
  synthetic polypeptide
LLIYAATSRH

SEQ ID NO: 5246 - protein, 10 aa, Artificial Sequence
  synthetic polypeptide
LVIYAATSLA

SEQ ID NO: 5247 - protein, 10 aa, Artificial Sequence
  synthetic polypeptide
LLIYAASSLQ

SEQ ID NO: 5248 - protein, 10 aa, Artificial Sequence
  synthetic polypeptide
LVIYAATSRH

SEQ ID NO: 5249 - protein, 10 aa, Artificial Sequence
  synthetic polypeptide
LVIYAATSLA

SEQ ID NO: 5250 - protein, 10 aa, Artificial Sequence
  synthetic polypeptide
LVIYAATSLA

SEQ ID NO: 5251 - protein, 10 aa, Artificial Sequence
  synthetic polypeptide
LLIYAATSRH

SEQ ID NO: 5252 - protein, 10 aa, Artificial Sequence
  synthetic polypeptide
LLIYAATSRA

SEQ ID NO: 5253 - protein, 10 aa, Artificial Sequence
  synthetic polypeptide
LLIYAATSLA

SEQ ID NO: 5254 - protein, 10 aa, Artificial Sequence
  synthetic polypeptide
LVIYAATSRH

SEQ ID NO: 5255 - protein, 10 aa, Artificial Sequence
  synthetic polypeptide
LLIYAATSRA

SEQ ID NO: 5256 - protein, 10 aa, Artificial Sequence
  synthetic polypeptide
LVIYAATSRA

SEQ ID NO: 5257 - protein, 10 aa, Artificial Sequence
  synthetic polypeptide
LLIYAATSRA

SEQ ID NO: 5258 - protein, 10 aa, Artificial Sequence
  synthetic polypeptide
LLIYAATSLH

SEQ ID NO: 5259 - protein, 10 aa, Artificial Sequence
  synthetic polypeptide
LLIYAATSRA

SEQ ID NO: 5260 - protein, 10 aa, Artificial Sequence
  synthetic polypeptide
LLIYAATSRA

SEQ ID NO: 5261 - protein, 10 aa, Artificial Sequence
  synthetic polypeptide
LLIYAATSLA

SEQ ID NO: 5262 - protein, 10 aa, Artificial Sequence
  synthetic polypeptide
LVIYAATSLA

SEQ ID NO: 5263 - protein, 10 aa, Artificial Sequence
  synthetic polypeptide
LLIYAATSRA

SEQ ID NO: 5264 - protein, 10 aa, Artificial Sequence
  synthetic polypeptide
LLIYAATSRA

SEQ ID NO: 5265 - protein, 10 aa, Artificial Sequence
  synthetic polypeptide
LLIYAATSRA

SEQ ID NO: 5266 - protein, 10 aa, Artificial Sequence
  synthetic polypeptide
LLIYAATSRA

SEQ ID NO: 5267 - protein, 10 aa, Artificial Sequence
  synthetic polypeptide
LLIYAATSRA

SEQ ID NO: 5268 - protein, 10 aa, Artificial Sequence
  synthetic polypeptide
LLIYAATSRA

SEQ ID NO: 5269 - protein, 10 aa, Artificial Sequence
  synthetic polypeptide
LLIYAATSRA

SEQ ID NO: 5270 - protein, 10 aa, Artificial Sequence
  synthetic polypeptide
LLIYAASSLQ

SEQ ID NO: 5271 - protein, 10 aa, Artificial Sequence
  synthetic polypeptide
LVIYAATSRA

SEQ ID NO: 5272 - protein, 10 aa, Artificial Sequence
  synthetic polypeptide
LVIYAVTSLH

SEQ ID NO: 5273 - protein, 10 aa, Artificial Sequence
  synthetic polypeptide
LLIYAATSLA

SEQ ID NO: 5274 - protein, 10 aa, Artificial Sequence
  synthetic polypeptide
LVIYAATSLA

SEQ ID NO: 5275 - protein, 10 aa, Artificial Sequence
  synthetic polypeptide
LLIYAATSRA

SEQ ID NO: 5276 - protein, 10 aa, Artificial Sequence
  synthetic polypeptide
LVIYAATSLA

SEQ ID NO: 5277 - protein, 10 aa, Artificial Sequence
  synthetic polypeptide
LLIYAATSLA

SEQ ID NO: 5278 - protein, 10 aa, Artificial Sequence
  synthetic polypeptide
LLIYATTSRH

SEQ ID NO: 5279 - protein, 10 aa, Artificial Sequence
  synthetic polypeptide
LVIYAATSLA

SEQ ID NO: 5280 - protein, 10 aa, Artificial Sequence
  synthetic polypeptide
LVIYAATSRH

SEQ ID NO: 5281 - protein, 10 aa, Artificial Sequence
  synthetic polypeptide
LLIYAATSRH

SEQ ID NO: 5282 - protein, 10 aa, Artificial Sequence
  synthetic polypeptide
LLIYAATSRH

SEQ ID NO: 5283 - protein, 10 aa, Artificial Sequence
  synthetic polypeptide
LLIYAATSLA

SEQ ID NO: 5284 - protein, 10 aa, Artificial Sequence
  synthetic polypeptide
LVIYAATSRA

SEQ ID NO: 5285 - protein, 10 aa, Artificial Sequence
  synthetic polypeptide
LLIYAATSRH

SEQ ID NO: 5286 - protein, 10 aa, Artificial Sequence
  synthetic polypeptide
LLIYAATSRA

SEQ ID NO: 5287 - protein, 10 aa, Artificial Sequence
  synthetic polypeptide
LLIYAATSLA

SEQ ID NO: 5288 - protein, 10 aa, Artificial Sequence
  synthetic polypeptide
LVIYAVTSLA

SEQ ID NO: 5289 - protein, 10 aa, Artificial Sequence
  synthetic polypeptide
LLIYAATSRH

SEQ ID NO: 5290 - protein, 10 aa, Artificial Sequence
  synthetic polypeptide
LLIYAASSLQ

SEQ ID NO: 5291 - protein, 10 aa, Artificial Sequence
  synthetic polypeptide
LVIYAATSRA

SEQ ID NO: 5292 - protein, 10 aa, Artificial Sequence
  synthetic polypeptide
LLIYAASSLQ

SEQ ID NO: 5293 - protein, 10 aa, Artificial Sequence
  synthetic polypeptide
LVIYAATSRA

SEQ ID NO: 5294 - protein, 10 aa, Artificial Sequence
  synthetic polypeptide
LLIYAATSRA

SEQ ID NO: 5295 - protein, 8 aa, Artificial Sequence
  synthetic polypeptide
QQSYENPL

SEQ ID NO: 5296 - protein, 8 aa, Artificial Sequence
  synthetic polypeptide
QQSDESPL

SEQ ID NO: 5297 - protein, 8 aa, Artificial Sequence
  synthetic polypeptide
QQSYDSPL

SEQ ID NO: 5298 - protein, 8 aa, Artificial Sequence
  synthetic polypeptide
QQSYDSPL

SEQ ID NO: 5299 - protein, 8 aa, Artificial Sequence
  synthetic polypeptide
QQSYDSPL

SEQ ID NO: 5300 - protein, 8 aa, Artificial Sequence
  synthetic polypeptide
QQSYSNPL

SEQ ID NO: 5301 - protein, 8 aa, Artificial Sequence
  synthetic polypeptide
QQSYENPL

SEQ ID NO: 5302 - protein, 8 aa, Artificial Sequence
  synthetic polypeptide
QQSYENPL

SEQ ID NO: 5303 - protein, 8 aa, Artificial Sequence
  synthetic polypeptide
QQSYNTPL

SEQ ID NO: 5304 - protein, 8 aa, Artificial Sequence
  synthetic polypeptide
QQSDSLPL

SEQ ID NO: 5305 - protein, 8 aa, Artificial Sequence
  synthetic polypeptide
QQSYSSPL

SEQ ID NO: 5306 - protein, 8 aa, Artificial Sequence
  synthetic polypeptide
QQSYDTPL

SEQ ID NO: 5307 - protein, 8 aa, Artificial Sequence
  synthetic polypeptide
QQSYDSPL

SEQ ID NO: 5308 - protein, 8 aa, Artificial Sequence
  synthetic polypeptide
QQSYDNPL

SEQ ID NO: 5309 - protein, 8 aa, Artificial Sequence
  synthetic polypeptide
QQSYDNPL

SEQ ID NO: 5310 - protein, 8 aa, Artificial Sequence
  synthetic polypeptide
QQSYDLPL

SEQ ID NO: 5311 - protein, 8 aa, Artificial Sequence
  synthetic polypeptide
QQSYDLPL

SEQ ID NO: 5312 - protein, 8 aa, Artificial Sequence
  synthetic polypeptide
QQSYDLPL

SEQ ID NO: 5313 - protein, 8 aa, Artificial Sequence
  synthetic polypeptide
QQSYDTPL

SEQ ID NO: 5314 - protein, 8 aa, Artificial Sequence
  synthetic polypeptide
QQSYSTPL

SEQ ID NO: 5315 - protein, 8 aa, Artificial Sequence
  synthetic polypeptide
QQSYESPL

SEQ ID NO: 5316 - protein, 8 aa, Artificial Sequence
  synthetic polypeptide
QQSYSTPL

SEQ ID NO: 5317 - protein, 8 aa, Artificial Sequence
  synthetic polypeptide
QQSYSTPL

SEQ ID NO: 5318 - protein, 8 aa, Artificial Sequence
  synthetic polypeptide
QQSYSTPL

SEQ ID NO: 5319 - protein, 8 aa, Artificial Sequence
  synthetic polypeptide
QQSYSTPL

SEQ ID NO: 5320 - protein, 8 aa, Artificial Sequence
  synthetic polypeptide
QQSYDTPL

SEQ ID NO: 5321 - protein, 8 aa, Artificial Sequence
  synthetic polypeptide
QQSYDTPL

SEQ ID NO: 5322 - protein, 8 aa, Artificial Sequence
  synthetic polypeptide
QQSYENPL

SEQ ID NO: 5323 - protein, 8 aa, Artificial Sequence
  synthetic polypeptide
QQSYESPL

SEQ ID NO: 5324 - protein, 8 aa, Artificial Sequence
  synthetic polypeptide
QQSYSLPL

SEQ ID NO: 5325 - protein, 8 aa, Artificial Sequence
  synthetic polypeptide
QQSYDTPL

SEQ ID NO: 5326 - protein, 8 aa, Artificial Sequence
  synthetic polypeptide
QQSYNLPL

SEQ ID NO: 5327 - protein, 8 aa, Artificial Sequence
  synthetic polypeptide
QQSYNLPL

SEQ ID NO: 5328 - protein, 8 aa, Artificial Sequence
  synthetic polypeptide
QQSYNSPL

SEQ ID NO: 5329 - protein, 8 aa, Artificial Sequence
  synthetic polypeptide
QQSYNSPL

SEQ ID NO: 5330 - protein, 8 aa, Artificial Sequence
  synthetic polypeptide
QQSYNTPL

SEQ ID NO: 5331 - protein, 8 aa, Artificial Sequence
  synthetic polypeptide
QQSYSTPL

SEQ ID NO: 5332 - protein, 8 aa, Artificial Sequence
  synthetic polypeptide
QQSYDLPL

SEQ ID NO: 5333 - protein, 8 aa, Artificial Sequence
  synthetic polypeptide
QQSYDNPL

SEQ ID NO: 5334 - protein, 8 aa, Artificial Sequence
  synthetic polypeptide
QQSYELPL

SEQ ID NO: 5335 - protein, 8 aa, Artificial Sequence
  synthetic polypeptide
QQSYELPL

SEQ ID NO: 5336 - protein, 8 aa, Artificial Sequence
  synthetic polypeptide
QQSYDTPL

SEQ ID NO: 5337 - protein, 8 aa, Artificial Sequence
  synthetic polypeptide
QQSYSNPL

SEQ ID NO: 5338 - protein, 8 aa, Artificial Sequence
  synthetic polypeptide
QQSYNLPL

SEQ ID NO: 5339 - protein, 8 aa, Artificial Sequence
  synthetic polypeptide
QQSYDLPL

SEQ ID NO: 5340 - protein, 8 aa, Artificial Sequence
  synthetic polypeptide
QQSYESPL

SEQ ID NO: 5341 - protein, 8 aa, Artificial Sequence
  synthetic polypeptide
QQSYSTPL

SEQ ID NO: 5342 - protein, 8 aa, Artificial Sequence
  synthetic polypeptide
QQSYDNPL

SEQ ID NO: 5343 - protein, 8 aa, Artificial Sequence
  synthetic polypeptide
QQSYDNPL

SEQ ID NO: 5344 - protein, 8 aa, Artificial Sequence
  synthetic polypeptide
QQSYDNPL

SEQ ID NO: 5345 - protein, 8 aa, Artificial Sequence
  synthetic polypeptide
QQSYDNPL

SEQ ID NO: 5346 - protein, 8 aa, Artificial Sequence
  synthetic polypeptide
QQSYELPL

SEQ ID NO: 5347 - protein, 8 aa, Artificial Sequence
  synthetic polypeptide
QQSYDNPL

SEQ ID NO: 5348 - protein, 8 aa, Artificial Sequence
  synthetic polypeptide
QQSYDNPL

SEQ ID NO: 5349 - protein, 8 aa, Artificial Sequence
  synthetic polypeptide
QQSYELPL

SEQ ID NO: 5350 - protein, 8 aa, Artificial Sequence
  synthetic polypeptide
QQSYENPL

SEQ ID NO: 5351 - protein, 8 aa, Artificial Sequence
  synthetic polypeptide
QQSYELPL

SEQ ID NO: 5352 - protein, 8 aa, Artificial Sequence
  synthetic polypeptide
QQSYNTPL

SEQ ID NO: 5353 - protein, 8 aa, Artificial Sequence
  synthetic polypeptide
QQSYDLPL

SEQ ID NO: 5354 - protein, 8 aa, Artificial Sequence
  synthetic polypeptide
QQSYDSPL

SEQ ID NO: 5355 - protein, 8 aa, Artificial Sequence
  synthetic polypeptide
QQSYDSPL

SEQ ID NO: 5356 - protein, 8 aa, Artificial Sequence
  synthetic polypeptide
QQSYSTPL

SEQ ID NO: 5357 - protein, 8 aa, Artificial Sequence
  synthetic polypeptide
QQSYNLPL

SEQ ID NO: 5358 - protein, 8 aa, Artificial Sequence
  synthetic polypeptide
QQSYDNPL

SEQ ID NO: 5359 - protein, 8 aa, Artificial Sequence
  synthetic polypeptide
QQSYDNPL

SEQ ID NO: 5360 - protein, 8 aa, Artificial Sequence
  synthetic polypeptide
QQSYDNPL

SEQ ID NO: 5361 - protein, 8 aa, Artificial Sequence
  synthetic polypeptide
QQSYDNPL

SEQ ID NO: 5362 - protein, 8 aa, Artificial Sequence
  synthetic polypeptide
QQSYDLPL

SEQ ID NO: 5363 - protein, 8 aa, Artificial Sequence
  synthetic polypeptide
QQSYSLPL

SEQ ID NO: 5364 - protein, 8 aa, Artificial Sequence
  synthetic polypeptide
QQSYDTPL

SEQ ID NO: 5365 - protein, 8 aa, Artificial Sequence
  synthetic polypeptide
QQSYELPL

SEQ ID NO: 5366 - protein, 8 aa, Artificial Sequence
  synthetic polypeptide
QQSYESPL

SEQ ID NO: 5367 - protein, 8 aa, Artificial Sequence
  synthetic polypeptide
QQSYENPL

SEQ ID NO: 5368 - protein, 8 aa, Artificial Sequence
  synthetic polypeptide
QQSYSSPL

SEQ ID NO: 5369 - protein, 8 aa, Artificial Sequence
  synthetic polypeptide
QQSYDNPL

SEQ ID NO: 5370 - protein, 8 aa, Artificial Sequence
  synthetic polypeptide
QQSYDSPL

SEQ ID NO: 5371 - protein, 8 aa, Artificial Sequence
  synthetic polypeptide
QQSYDLPL

SEQ ID NO: 5372 - protein, 8 aa, Artificial Sequence
  synthetic polypeptide
QQSYELPL

SEQ ID NO: 5373 - protein, 8 aa, Artificial Sequence
  synthetic polypeptide
QQSYDLPL

SEQ ID NO: 5374 - protein, 8 aa, Artificial Sequence
  synthetic polypeptide
QQSYDLPL

SEQ ID NO: 5375 - protein, 8 aa, Artificial Sequence
  synthetic polypeptide
QQSYENPL

SEQ ID NO: 5376 - protein, 8 aa, Artificial Sequence
  synthetic polypeptide
QQSYSSPL

SEQ ID NO: 5377 - protein, 8 aa, Artificial Sequence
  synthetic polypeptide
QQSDELPL

SEQ ID NO: 5378 - protein, 8 aa, Artificial Sequence
  synthetic polypeptide
QQSYENPL

SEQ ID NO: 5379 - protein, 8 aa, Artificial Sequence
  synthetic polypeptide
QQSYDLPL

SEQ ID NO: 5380 - protein, 8 aa, Artificial Sequence
  synthetic polypeptide
QQSYESPL

SEQ ID NO: 5381 - protein, 8 aa, Artificial Sequence
  synthetic polypeptide
QQSYDLPL

SEQ ID NO: 5382 - protein, 8 aa, Artificial Sequence
  synthetic polypeptide
QQSYDLPL

SEQ ID NO: 5383 - protein, 8 aa, Artificial Sequence
  synthetic polypeptide
QQSYENPL

SEQ ID NO: 5384 - protein, 8 aa, Artificial Sequence
  synthetic polypeptide
QQSYETPL

SEQ ID NO: 5385 - protein, 8 aa, Artificial Sequence
  synthetic polypeptide
QQSYENPL

SEQ ID NO: 5386 - protein, 8 aa, Artificial Sequence
  synthetic polypeptide
QQSYENPL

SEQ ID NO: 5387 - protein, 8 aa, Artificial Sequence
  synthetic polypeptide
QQSYSTPL

SEQ ID NO: 5388 - protein, 8 aa, Artificial Sequence
  synthetic polypeptide
QQSYDSPL

SEQ ID NO: 5389 - protein, 8 aa, Artificial Sequence
  synthetic polypeptide
QQSYDNPL

SEQ ID NO: 5390 - protein, 8 aa, Artificial Sequence
  synthetic polypeptide
QQSYDSPL

SEQ ID NO: 5391 - protein, 8 aa, Artificial Sequence
  synthetic polypeptide
QQSYNLPL

SEQ ID NO: 5392 - protein, 8 aa, Artificial Sequence
  synthetic polypeptide
QQSYDTPL

SEQ ID NO: 5393 - protein, 8 aa, Artificial Sequence
  synthetic polypeptide
QQSYELPL

SEQ ID NO: 5394 - protein, 8 aa, Artificial Sequence
  synthetic polypeptide
QQSYDLPL

SEQ ID NO: 5395 - protein, 8 aa, Artificial Sequence
  synthetic polypeptide
QQSYDSPL

SEQ ID NO: 5396 - protein, 8 aa, Artificial Sequence
  synthetic polypeptide
QQSYENPL

SEQ ID NO: 5397 - protein, 8 aa, Artificial Sequence
  synthetic polypeptide
QQSYETPL

SEQ ID NO: 5398 - protein, 8 aa, Artificial Sequence
  synthetic polypeptide
  misc_feature (5)..(5): Xaa can be any naturally occurring amino acid
QQSYXTPL

SEQ ID NO: 5399 - protein, 8 aa, Artificial Sequence
  synthetic polypeptide
QQSYNSPL

SEQ ID NO: 5400 - protein, 8 aa, Artificial Sequence
  synthetic polypeptide
QQSYDNPL

SEQ ID NO: 5401 - protein, 8 aa, Artificial Sequence
  synthetic polypeptide
QQSYELPL

SEQ ID NO: 5402 - protein, 8 aa, Artificial Sequence
  synthetic polypeptide
QQSYNSPL

SEQ ID NO: 5403 - protein, 8 aa, Artificial Sequence
  synthetic polypeptide
QQSYDLPL

SEQ ID NO: 5404 - protein, 8 aa, Artificial Sequence
  synthetic polypeptide
QQSYNSPL

SEQ ID NO: 5405 - protein, 8 aa, Artificial Sequence
  synthetic polypeptide
QQSYELPL

SEQ ID NO: 5406 - protein, 8 aa, Artificial Sequence
  synthetic polypeptide
QQSYDTPL

SEQ ID NO: 5407 - protein, 8 aa, Artificial Sequence
  synthetic polypeptide
QQSYDTPL

SEQ ID NO: 5408 - protein, 8 aa, Artificial Sequence
  synthetic polypeptide
QQSYESPL

SEQ ID NO: 5409 - protein, 8 aa, Artificial Sequence
  synthetic polypeptide
QQSYSLPL

SEQ ID NO: 5410 - protein, 8 aa, Artificial Sequence
  synthetic polypeptide
QQSYDLPL

SEQ ID NO: 5411 - protein, 8 aa, Artificial Sequence
  synthetic polypeptide
QQSYNLPL

SEQ ID NO: 5412 - protein, 8 aa, Artificial Sequence
  synthetic polypeptide
QQSYNNPL

SEQ ID NO: 5413 - protein, 8 aa, Artificial Sequence
  synthetic polypeptide
QQSYESPL

SEQ ID NO: 5414 - protein, 8 aa, Artificial Sequence
  synthetic polypeptide
QQSYDLPL

SEQ ID NO: 5415 - protein, 8 aa, Artificial Sequence
  synthetic polypeptide
QQSYDLPL

SEQ ID NO: 5416 - protein, 8 aa, Artificial Sequence
  synthetic polypeptide
QQSYDTPL

SEQ ID NO: 5417 - protein, 8 aa, Artificial Sequence
  synthetic polypeptide
QQSYENPL

SEQ ID NO: 5418 - protein, 8 aa, Artificial Sequence
  synthetic polypeptide
QQSYSTPL

SEQ ID NO: 5419 - protein, 8 aa, Artificial Sequence
  synthetic polypeptide
QQSDETPL

SEQ ID NO: 5420 - protein, 8 aa, Artificial Sequence
  synthetic polypeptide
QQSDSLPL

SEQ ID NO: 5421 - protein, 8 aa, Artificial Sequence
  synthetic polypeptide
QQSYENPL

SEQ ID NO: 5422 - protein, 8 aa, Artificial Sequence
  synthetic polypeptide
QQSYNLPL

SEQ ID NO: 5423 - protein, 8 aa, Artificial Sequence
  synthetic polypeptide
QQSYSNPL

SEQ ID NO: 5424 - protein, 8 aa, Artificial Sequence
  synthetic polypeptide
QQSNNLPL

SEQ ID NO: 5425 - protein, 8 aa, Artificial Sequence
  synthetic polypeptide
QQSYSNPL

SEQ ID NO: 5426 - protein, 8 aa, Artificial Sequence
  synthetic polypeptide
QQSYSTPL

SEQ ID NO: 5427 - protein, 8 aa, Artificial Sequence
  synthetic polypeptide
QQSDERPL

SEQ ID NO: 5428 - protein, 8 aa, Artificial Sequence
  synthetic polypeptide
QQSYDLPL

SEQ ID NO: 5429 - protein, 8 aa, Artificial Sequence
  synthetic polypeptide
QQSYDLPL

SEQ ID NO: 5430 - protein, 8 aa, Artificial Sequence
  synthetic polypeptide
QQSYDLPL

SEQ ID NO: 5431 - protein, 8 aa, Artificial Sequence
  synthetic polypeptide
QQSYENPL

SEQ ID NO: 5432 - protein, 8 aa, Artificial Sequence
  synthetic polypeptide
QQSDNLPL

SEQ ID NO: 5433 - protein, 8 aa, Artificial Sequence
  synthetic polypeptide
QQSYENPL

SEQ ID NO: 5434 - protein, 8 aa, Artificial Sequence
  synthetic polypeptide
QQSDELPL

SEQ ID NO: 5435 - protein, 8 aa, Artificial Sequence
  synthetic polypeptide
QQSYDNPL

SEQ ID NO: 5436 - protein, 8 aa, Artificial Sequence
  synthetic polypeptide
QQSYNSPL

SEQ ID NO: 5437 - protein, 8 aa, Artificial Sequence
  synthetic polypeptide
QQSYSLPL

SEQ ID NO: 5438 - protein, 8 aa, Artificial Sequence
  synthetic polypeptide
QQSYNSPL

SEQ ID NO: 5439 - protein, 8 aa, Artificial Sequence
  synthetic polypeptide
QQSYSTPL

SEQ ID NO: 5440 - protein, 8 aa, Artificial Sequence
  synthetic polypeptide
QQSYDLPL

SEQ ID NO: 5441 - protein, 8 aa, Artificial Sequence
  synthetic polypeptide
QQSYELPL

SEQ ID NO: 5442 - protein, 8 aa, Artificial Sequence
  synthetic polypeptide
QQSYDLPL

SEQ ID NO: 5443 - protein, 8 aa, Artificial Sequence
  synthetic polypeptide
QQSYDTPL

SEQ ID NO: 5444 - protein, 8 aa, Artificial Sequence
  synthetic polypeptide
QQSYETPL

SEQ ID NO: 5445 - protein, 8 aa, Artificial Sequence
  synthetic polypeptide
QQSYESPL

SEQ ID NO: 5446 - protein, 8 aa, Artificial Sequence
  synthetic polypeptide
QQSYDLPL

SEQ ID NO: 5447 - protein, 8 aa, Artificial Sequence
  synthetic polypeptide
QQSYNLPL

SEQ ID NO: 5448 - protein, 8 aa, Artificial Sequence
  synthetic polypeptide
QQSYNSPL

SEQ ID NO: 5449 - protein, 8 aa, Artificial Sequence
  synthetic polypeptide
QQSYDTPL

SEQ ID NO: 5450 - protein, 8 aa, Artificial Sequence
  synthetic polypeptide
QQSYDLPL

SEQ ID NO: 5451 - protein, 8 aa, Artificial Sequence
  synthetic polypeptide
QQSYDTPL

SEQ ID NO: 5452 - protein, 8 aa, Artificial Sequence
  synthetic polypeptide
QQSYSNPL

SEQ ID NO: 5453 - protein, 8 aa, Artificial Sequence
  synthetic polypeptide
QQSYDTPL

SEQ ID NO: 5454 - protein, 8 aa, Artificial Sequence
  synthetic polypeptide
QQSDNNPL

SEQ ID NO: 5455 - protein, 8 aa, Artificial Sequence
  synthetic polypeptide
QQSYDLPL

SEQ ID NO: 5456 - protein, 8 aa, Artificial Sequence
  synthetic polypeptide
QQSYDTPL

SEQ ID NO: 5457 - protein, 8 aa, Artificial Sequence
  synthetic polypeptide
QQSYETPL

SEQ ID NO: 5458 - protein, 8 aa, Artificial Sequence
  synthetic polypeptide
QQSYNNPL

SEQ ID NO: 5459 - protein, 8 aa, Artificial Sequence
  synthetic polypeptide
QQSYSTPL

SEQ ID NO: 5460 - protein, 8 aa, Artificial Sequence
  synthetic polypeptide
QQSYDLPL

SEQ ID NO: 5461 - protein, 8 aa, Artificial Sequence
  synthetic polypeptide
QQSYSTPL

SEQ ID NO: 5462 - protein, 8 aa, Artificial Sequence
  synthetic polypeptide
QQSYDNPL

SEQ ID NO: 5463 - protein, 8 aa, Artificial Sequence
  synthetic polypeptide
QQSYSTPL

SEQ ID NO: 5464 - protein, 6 aa, Artificial Sequence
  synthetic polypeptide
SDYSMN

SEQ ID NO: 5465 - protein, 6 aa, Artificial Sequence
  synthetic polypeptide
DSYSMN

SEQ ID NO: 5466 - protein, 6 aa, Artificial Sequence
  synthetic polypeptide
SDYGMN

SEQ ID NO: 5467 - protein, 6 aa, Artificial Sequence
  synthetic polypeptide
SSYSMN

SEQ ID NO: 5468 - protein, 6 aa, Artificial Sequence
  synthetic polypeptide
DSYSMN

SEQ ID NO: 5469 - protein, 6 aa, Artificial Sequence
  synthetic polypeptide
SSYGMN

SEQ ID NO: 5470 - protein, 6 aa, Artificial Sequence
  synthetic polypeptide
DSYSMN

SEQ ID NO: 5471 - protein, 6 aa, Artificial Sequence
  synthetic polypeptide
SSYGMN

SEQ ID NO: 5472 - protein, 6 aa, Artificial Sequence
  synthetic polypeptide
SSYSMN

SEQ ID NO: 5473 - protein, 6 aa, Artificial Sequence
  synthetic polypeptide
DSYSMN

SEQ ID NO: 5474 - protein, 6 aa, Artificial Sequence
  synthetic polypeptide
SDYSMN

SEQ ID NO: 5475 - protein, 6 aa, Artificial Sequence
  synthetic polypeptide
DDYSMN

SEQ ID NO: 5476 - protein, 6 aa, Artificial Sequence
  synthetic polypeptide
SDYSMN

SEQ ID NO: 5477 - protein, 6 aa, Artificial Sequence
  synthetic polypeptide
SDYGMN

SEQ ID NO: 5478 - protein, 6 aa, Artificial Sequence
  synthetic polypeptide
DSYGMN

SEQ ID NO: 5479 - protein, 6 aa, Artificial Sequence
  synthetic polypeptide
SDYSMN

SEQ ID NO: 5480 - protein, 6 aa, Artificial Sequence
  synthetic polypeptide
SSYGMN

SEQ ID NO: 5481 - protein, 6 aa, Artificial Sequence
  synthetic polypeptide
SSYGMH

SEQ ID NO: 5482 - protein, 6 aa, Artificial Sequence
  synthetic polypeptide
DSYGMN

SEQ ID NO: 5483 - protein, 6 aa, Artificial Sequence
  synthetic polypeptide
DSYGMN

SEQ ID NO: 5484 - protein, 6 aa, Artificial Sequence
  synthetic polypeptide
DSYGMN

SEQ ID NO: 5485 - protein, 6 aa, Artificial Sequence
  synthetic polypeptide
DSYGMN

SEQ ID NO: 5486 - protein, 6 aa, Artificial Sequence
  synthetic polypeptide
SSYGMN

SEQ ID NO: 5487 - protein, 6 aa, Artificial Sequence
  synthetic polypeptide
SSYGMN

SEQ ID NO: 5488 - protein, 6 aa, Artificial Sequence
  synthetic polypeptide
SSYSMN

SEQ ID NO: 5489 - protein, 6 aa, Artificial Sequence
  synthetic polypeptide
DSYSMN

SEQ ID NO: 5490 - protein, 6 aa, Artificial Sequence
  synthetic polypeptide
SSYGMH

SEQ ID NO: 5491 - protein, 6 aa, Artificial Sequence
  synthetic polypeptide
SSYSMN

SEQ ID NO: 5492 - protein, 6 aa, Artificial Sequence
  synthetic polypeptide
DSYSMN

SEQ ID NO: 5493 - protein, 6 aa, Artificial Sequence
  synthetic polypeptide
DSYSMN

SEQ ID NO: 5494 - protein, 6 aa, Artificial Sequence
  synthetic polypeptide
DSYSMN

SEQ ID NO: 5495 - protein, 6 aa, Artificial Sequence
  synthetic polypeptide
SDYSMN

SEQ ID NO: 5496 - protein, 6 aa, Artificial Sequence
  synthetic polypeptide
SSYSMN

SEQ ID NO: 5497 - protein, 6 aa, Artificial Sequence
  synthetic polypeptide
SSYGMN

SEQ ID NO: 5498 - protein, 6 aa, Artificial Sequence
  synthetic polypeptide
DSYSMN

SEQ ID NO: 5499 - protein, 6 aa, Artificial Sequence
  synthetic polypeptide
DSYGMN

SEQ ID NO: 5500 - protein, 6 aa, Artificial Sequence
  synthetic polypeptide
SSYSMN

SEQ ID NO: 5501 - protein, 6 aa, Artificial Sequence
  synthetic polypeptide
DSYGMN

SEQ ID NO: 5502 - protein, 6 aa, Artificial Sequence
  synthetic polypeptide
SSYGMN

SEQ ID NO: 5503 - protein, 6 aa, Artificial Sequence
  synthetic polypeptide
SSYSMN

SEQ ID NO: 5504 - protein, 6 aa, Artificial Sequence
  synthetic polypeptide
DDYSMN

SEQ ID NO: 5505 - protein, 6 aa, Artificial Sequence
  synthetic polypeptide
DSYGMN

SEQ ID NO: 5506 - protein, 6 aa, Artificial Sequence
  synthetic polypeptide
DDYSMN

SEQ ID NO: 5507 - protein, 6 aa, Artificial Sequence
  synthetic polypeptide
SDYSMN

SEQ ID NO: 5508 - protein, 6 aa, Artificial Sequence
  synthetic polypeptide
SDYGMN

SEQ ID NO: 5509 - protein, 6 aa, Artificial Sequence
  synthetic polypeptide
SSYGMN

SEQ ID NO: 5510 - protein, 6 aa, Artificial Sequence
  synthetic polypeptide
SSYGMN

SEQ ID NO: 5511 - protein, 6 aa, Artificial Sequence
  synthetic polypeptide
SSYSMN

SEQ ID NO: 5512 - protein, 6 aa, Artificial Sequence
  synthetic polypeptide
SSYSMN

SEQ ID NO: 5513 - protein, 6 aa, Artificial Sequence
  synthetic polypeptide
DSYSMN

SEQ ID NO: 5514 - protein, 6 aa, Artificial Sequence
  synthetic polypeptide
DSYSMN

SEQ ID NO: 5515 - protein, 6 aa, Artificial Sequence
  synthetic polypeptide
SSYSMN

SEQ ID NO: 5516 - protein, 6 aa, Artificial Sequence
  synthetic polypeptide
SSYGMN

SEQ ID NO: 5517 - protein, 6 aa, Artificial Sequence
  synthetic polypeptide
SDYGMN

SEQ ID NO: 5518 - protein, 6 aa, Artificial Sequence
  synthetic polypeptide
SSYGMN

SEQ ID NO: 5519 - protein, 6 aa, Artificial Sequence
  synthetic polypeptide
SDYGMH

SEQ ID NO: 5520 - protein, 6 aa, Artificial Sequence
  synthetic polypeptide
DSYSMN

SEQ ID NO: 5521 - protein, 6 aa, Artificial Sequence
  synthetic polypeptide
DSYGMN

SEQ ID NO: 5522 - protein, 6 aa, Artificial Sequence
  synthetic polypeptide
SSYSMN

SEQ ID NO: 5523 - protein, 6 aa, Artificial Sequence
  synthetic polypeptide
DSYSMN

SEQ ID NO: 5524 - protein, 6 aa, Artificial Sequence
  synthetic polypeptide
SDYSMN

SEQ ID NO: 5525 - protein, 6 aa, Artificial Sequence
  synthetic polypeptide
SSYSMN

SEQ ID NO: 5526 - protein, 6 aa, Artificial Sequence
  synthetic polypeptide
DDYSMN

SEQ ID NO: 5527 - protein, 6 aa, Artificial Sequence
  synthetic polypeptide
SSYGMN

SEQ ID NO: 5528 - protein, 6 aa, Artificial Sequence
  synthetic polypeptide
DSYSMN

SEQ ID NO: 5529 - protein, 6 aa, Artificial Sequence
  synthetic polypeptide
SSYSMN

SEQ ID NO: 5530 - protein, 6 aa, Artificial Sequence
  synthetic polypeptide
DDYSMN

SEQ ID NO: 5531 - protein, 6 aa, Artificial Sequence
  synthetic polypeptide
SSYGMH

SEQ ID NO: 5532 - protein, 6 aa, Artificial Sequence
  synthetic polypeptide
SSYSMN

SEQ ID NO: 5533 - protein, 6 aa, Artificial Sequence
  synthetic polypeptide
SSYSMN

SEQ ID NO: 5534 - protein, 6 aa, Artificial Sequence
  synthetic polypeptide
SDYSMN

SEQ ID NO: 5535 - protein, 6 aa, Artificial Sequence
  synthetic polypeptide
SSYGMH

SEQ ID NO: 5536 - protein, 6 aa, Artificial Sequence
  synthetic polypeptide
DSYGMN

SEQ ID NO: 5537 - protein, 6 aa, Artificial Sequence
  synthetic polypeptide
SDYGMH

SEQ ID NO: 5538 - protein, 6 aa, Artificial Sequence
  synthetic polypeptide
SSYSMN

SEQ ID NO: 5539 - protein, 6 aa, Artificial Sequence
  synthetic polypeptide
DDYSMN

SEQ ID NO: 5540 - protein, 6 aa, Artificial Sequence
  synthetic polypeptide
DDYSMN

SEQ ID NO: 5541 - protein, 6 aa, Artificial Sequence
  synthetic polypeptide
SSYSMN

SEQ ID NO: 5542 - protein, 6 aa, Artificial Sequence
  synthetic polypeptide
DSYSMN

SEQ ID NO: 5543 - protein, 6 aa, Artificial Sequence
  synthetic polypeptide
DSYSMN

SEQ ID NO: 5544 - protein, 6 aa, Artificial Sequence
  synthetic polypeptide
DSYGMN

SEQ ID NO: 5545 - protein, 6 aa, Artificial Sequence
  synthetic polypeptide
SSYSMN

SEQ ID NO: 5546 - protein, 6 aa, Artificial Sequence
  synthetic polypeptide
DSYGMN

SEQ ID NO: 5547 - protein, 6 aa, Artificial Sequence
  synthetic polypeptide
DSYSMN

SEQ ID NO: 5548 - protein, 6 aa, Artificial Sequence
  synthetic polypeptide
SSYSMN

SEQ ID NO: 5549 - protein, 6 aa, Artificial Sequence
  synthetic polypeptide
SSYGMN

SEQ ID NO: 5550 - protein, 6 aa, Artificial Sequence
  synthetic polypeptide
SSYGMN

SEQ ID NO: 5551 - protein, 6 aa, Artificial Sequence
  synthetic polypeptide
SSYGMN

SEQ ID NO: 5552 - protein, 6 aa, Artificial Sequence
  synthetic polypeptide
DSYGMN

SEQ ID NO: 5553 - protein, 6 aa, Artificial Sequence
  synthetic polypeptide
SSYGMN

SEQ ID NO: 5554 - protein, 6 aa, Artificial Sequence
  synthetic polypeptide
SSYSMN

SEQ ID NO: 5555 - protein, 6 aa, Artificial Sequence
  synthetic polypeptide
SSYSMN

SEQ ID NO: 5556 - protein, 6 aa, Artificial Sequence
  synthetic polypeptide
SDYSMN

SEQ ID NO: 5557 - protein, 6 aa, Artificial Sequence
  synthetic polypeptide
SSYSMN

SEQ ID NO: 5558 - protein, 6 aa, Artificial Sequence
  synthetic polypeptide
DDYSMN

SEQ ID NO: 5559 - protein, 6 aa, Artificial Sequence
  synthetic polypeptide
DSYSMN

SEQ ID NO: 5560 - protein, 6 aa, Artificial Sequence
  synthetic polypeptide
SSYGMN

SEQ ID NO: 5561 - protein, 6 aa, Artificial Sequence
  synthetic polypeptide
SDYSMN

SEQ ID NO: 5562 - protein, 6 aa, Artificial Sequence
  synthetic polypeptide
SDYSMN

SEQ ID NO: 5563 - protein, 6 aa, Artificial Sequence
  synthetic polypeptide
DSYSMN

SEQ ID NO: 5564 - protein, 6 aa, Artificial Sequence
  synthetic polypeptide
SNYGMN

SEQ ID NO: 5565 - protein, 6 aa, Artificial Sequence
  synthetic polypeptide
SSYSMN

SEQ ID NO: 5566 - protein, 6 aa, Artificial Sequence
  synthetic polypeptide
SDYSMN

SEQ ID NO: 5567 - protein, 6 aa, Artificial Sequence
  synthetic polypeptide
DSYSMN

SEQ ID NO: 5568 - protein, 6 aa, Artificial Sequence
  synthetic polypeptide
SSYSMN

SEQ ID NO: 5569 - protein, 6 aa, Artificial Sequence
  synthetic polypeptide
DSYSMN

SEQ ID NO: 5570 - protein, 6 aa, Artificial Sequence
  synthetic polypeptide
SSYSMN

SEQ ID NO: 5571 - protein, 6 aa, Artificial Sequence
  synthetic polypeptide
SSYSMN

SEQ ID NO: 5572 - protein, 6 aa, Artificial Sequence
  synthetic polypeptide
DSYSMN

SEQ ID NO: 5573 - protein, 6 aa, Artificial Sequence
  synthetic polypeptide
SDYSMN

SEQ ID NO: 5574 - protein, 6 aa, Artificial Sequence
  synthetic polypeptide
SSYSMN

SEQ ID NO: 5575 - protein, 6 aa, Artificial Sequence
  synthetic polypeptide
DSYGMH

SEQ ID NO: 5576 - protein, 6 aa, Artificial Sequence
  synthetic polypeptide
SSYSMN

SEQ ID NO: 5577 - protein, 6 aa, Artificial Sequence
  synthetic polypeptide
DSYSMN

SEQ ID NO: 5578 - protein, 6 aa, Artificial Sequence
  synthetic polypeptide
SSYSMN

SEQ ID NO: 5579 - protein, 6 aa, Artificial Sequence
  synthetic polypeptide
SSYSMN

SEQ ID NO: 5580 - protein, 6 aa, Artificial Sequence
  synthetic polypeptide
SSYGMN

SEQ ID NO: 5581 - protein, 6 aa, Artificial Sequence
  synthetic polypeptide
SSYSMN

SEQ ID NO: 5582 - protein, 6 aa, Artificial Sequence
  synthetic polypeptide
SSYSMN

SEQ ID NO: 5583 - protein, 6 aa, Artificial Sequence
  synthetic polypeptide
DSYSMN

SEQ ID NO: 5584 - protein, 6 aa, Artificial Sequence
  synthetic polypeptide
DSYSMN

SEQ ID NO: 5585 - protein, 6 aa, Artificial Sequence
  synthetic polypeptide
DSYSMN

SEQ ID NO: 5586 - protein, 6 aa, Artificial Sequence
  synthetic polypeptide
SSYSMN

SEQ ID NO: 5587 - protein, 6 aa, Artificial Sequence
  synthetic polypeptide
DSYGMN

SEQ ID NO: 5588 - protein, 6 aa, Artificial Sequence
  synthetic polypeptide
DSYGMN

SEQ ID NO: 5589 - protein, 6 aa, Artificial Sequence
  synthetic polypeptide
SSYSMN

SEQ ID NO: 5590 - protein, 6 aa, Artificial Sequence
  synthetic polypeptide
DSYSMN

SEQ ID NO: 5591 - protein, 6 aa, Artificial Sequence
  synthetic polypeptide
DSYSMN

SEQ ID NO: 5592 - protein, 6 aa, Artificial Sequence
  synthetic polypeptide
SSYSMN

SEQ ID NO: 5593 - protein, 6 aa, Artificial Sequence
  synthetic polypeptide
DSYSMN

SEQ ID NO: 5594 - protein, 6 aa, Artificial Sequence
  synthetic polypeptide
SSYGMH

SEQ ID NO: 5595 - protein, 6 aa, Artificial Sequence
  synthetic polypeptide
SSYSMN

SEQ ID NO: 5596 - protein, 6 aa, Artificial Sequence
  synthetic polypeptide
SSYSMN

SEQ ID NO: 5597 - protein, 6 aa, Artificial Sequence
  synthetic polypeptide
SSYSMN

SEQ ID NO: 5598 - protein, 6 aa, Artificial Sequence
  synthetic polypeptide
DSYSMN

SEQ ID NO: 5599 - protein, 6 aa, Artificial Sequence
  synthetic polypeptide
DSYSMN

SEQ ID NO: 5600 - protein, 6 aa, Artificial Sequence
  synthetic polypeptide
SDYSMN

SEQ ID NO: 5601 - protein, 6 aa, Artificial Sequence
  synthetic polypeptide
DSYSMN

SEQ ID NO: 5602 - protein, 6 aa, Artificial Sequence
  synthetic polypeptide
SSYSMN

SEQ ID NO: 5603 - protein, 6 aa, Artificial Sequence
  synthetic polypeptide
SSYSMN

SEQ ID NO: 5604 - protein, 6 aa, Artificial Sequence
  synthetic polypeptide
SDYSMN

SEQ ID NO: 5605 - protein, 6 aa, Artificial Sequence
  synthetic polypeptide
DSYSMN

SEQ ID NO: 5606 - protein, 6 aa, Artificial Sequence
  synthetic polypeptide
SSYSMN

SEQ ID NO: 5607 - protein, 6 aa, Artificial Sequence
  synthetic polypeptide
DSYSMN

SEQ ID NO: 5608 - protein, 6 aa, Artificial Sequence
  synthetic polypeptide
DSYSMN

SEQ ID NO: 5609 - protein, 6 aa, Artificial Sequence
  synthetic polypeptide
SSYSMN

SEQ ID NO: 5610 - protein, 6 aa, Artificial Sequence
  synthetic polypeptide
SSYSMN

SEQ ID NO: 5611 - protein, 6 aa, Artificial Sequence
  synthetic polypeptide
DSYSMN

SEQ ID NO: 5612 - protein, 6 aa, Artificial Sequence
  synthetic polypeptide
SDYSMN

SEQ ID NO: 5613 - protein, 6 aa, Artificial Sequence
  synthetic polypeptide
SSYSMN

SEQ ID NO: 5614 - protein, 6 aa, Artificial Sequence
  synthetic polypeptide
SSYSMN

SEQ ID NO: 5615 - protein, 6 aa, Artificial Sequence
  synthetic polypeptide
SDYSMN

SEQ ID NO: 5616 - protein, 6 aa, Artificial Sequence
  synthetic polypeptide
SDYSMN

SEQ ID NO: 5617 - protein, 6 aa, Artificial Sequence
  synthetic polypeptide
SSYSMN

SEQ ID NO: 5618 - protein, 6 aa, Artificial Sequence
  synthetic polypeptide
SSYSMN

SEQ ID NO: 5619 - protein, 6 aa, Artificial Sequence
  synthetic polypeptide
SSYSMN

SEQ ID NO: 5620 - protein, 6 aa, Artificial Sequence
  synthetic polypeptide
SSYSMN

SEQ ID NO: 5621 - protein, 6 aa, Artificial Sequence
  synthetic polypeptide
SDYSMN

SEQ ID NO: 5622 - protein, 6 aa, Artificial Sequence
  synthetic polypeptide
SSYGMN

SEQ ID NO: 5623 - protein, 6 aa, Artificial Sequence
  synthetic polypeptide
SSYGMN

SEQ ID NO: 5624 - protein, 6 aa, Artificial Sequence
  synthetic polypeptide
SSYSMN

SEQ ID NO: 5625 - protein, 6 aa, Artificial Sequence
  synthetic polypeptide
SSYSMN

SEQ ID NO: 5626 - protein, 6 aa, Artificial Sequence
  synthetic polypeptide
SSYSMN

SEQ ID NO: 5627 - protein, 6 aa, Artificial Sequence
  synthetic polypeptide
SSYGMN

SEQ ID NO: 5628 - protein, 6 aa, Artificial Sequence
  synthetic polypeptide
SSYSMN

SEQ ID NO: 5629 - protein, 6 aa, Artificial Sequence
  synthetic polypeptide
SDYSMN

SEQ ID NO: 5630 - protein, 6 aa, Artificial Sequence
  synthetic polypeptide
SSYGMN

SEQ ID NO: 5631 - protein, 6 aa, Artificial Sequence
  synthetic polypeptide
DSYSMN

SEQ ID NO: 5632 - protein, 6 aa, Artificial Sequence
  synthetic polypeptide
DSYSMN

SEQ ID NO: 5633 - protein, 6 aa, Artificial Sequence
  synthetic polypeptide
SSYSMN

SEQ ID NO: 5634 - protein, 6 aa, Artificial Sequence
  synthetic polypeptide
SSYSMN

SEQ ID NO: 5635 - protein, 6 aa, Artificial Sequence
  synthetic polypeptide
SDYSMN

SEQ ID NO: 5636 - protein, 6 aa, Artificial Sequence
  synthetic polypeptide
SSYGMN

SEQ ID NO: 5637 - protein, 6 aa, Artificial Sequence
  synthetic polypeptide
SSYSMN

SEQ ID NO: 5638 - protein, 6 aa, Artificial Sequence
  synthetic polypeptide
SSYGMN

SEQ ID NO: 5639 - protein, 6 aa, Artificial Sequence
  synthetic polypeptide
DSYGMN

SEQ ID NO: 5640 - protein, 6 aa, Artificial Sequence
  synthetic polypeptide
SDYSMN

SEQ ID NO: 5641 - protein, 6 aa, Artificial Sequence
  synthetic polypeptide
SSYSMN

SEQ ID NO: 5642 - protein, 6 aa, Artificial Sequence
  synthetic polypeptide
DSYSMN

SEQ ID NO: 5643 - protein, 13 aa, Artificial Sequence
  synthetic polypeptide
WVSGINYNGGYKG

SEQ ID NO: 5644 - protein, 13 aa, Artificial Sequence
  synthetic polypeptide
WVSSINYNSGYKG

SEQ ID NO: 5645 - protein, 13 aa, Artificial Sequence
  synthetic polypeptide
WVSNINYNGGYTG

SEQ ID NO: 5646 - protein, 13 aa, Artificial Sequence
  synthetic polypeptide
WVSGINYNGGYKG

SEQ ID NO: 5647 - protein, 13 aa, Artificial Sequence
  synthetic polypeptide
WVSSINYNGGYTS

SEQ ID NO: 5648 - protein, 13 aa, Artificial Sequence
  synthetic polypeptide
WVAGINYNSGYKG

SEQ ID NO: 5649 - protein, 13 aa, Artificial Sequence
  synthetic polypeptide
WVAGINYNGGYTG

SEQ ID NO: 5650 - protein, 13 aa, Artificial Sequence
  synthetic polypeptide
WVSGINYNGGYKG

SEQ ID NO: 5651 - protein, 13 aa, Artificial Sequence
  synthetic polypeptide
WVSGINYNGGYKS

SEQ ID NO: 5652 - protein, 13 aa, Artificial Sequence
  synthetic polypeptide
WVSGINYNGGYTS

SEQ ID NO: 5653 - protein, 13 aa, Artificial Sequence
  synthetic polypeptide
WVASINYNGGYKS

SEQ ID NO: 5654 - protein, 13 aa, Artificial Sequence
  synthetic polypeptide
WVSGINYNSGYKG

SEQ ID NO: 5655 - protein, 13 aa, Artificial Sequence
  synthetic polypeptide
WVSGINYNSGYKS

SEQ ID NO: 5656 - protein, 13 aa, Artificial Sequence
  synthetic polypeptide
WVSGINYNGGYTS

SEQ ID NO: 5657 - protein, 13 aa, Artificial Sequence
  synthetic polypeptide
WVSNINYNGGYKS

SEQ ID NO: 5658 - protein, 13 aa, Artificial Sequence
  synthetic polypeptide
WVSNINYNGGYTS

SEQ ID NO: 5659 - protein, 13 aa, Artificial Sequence
  synthetic polypeptide
WVSGINYNSGYTG

SEQ ID NO: 5660 - protein, 13 aa, Artificial Sequence
  synthetic polypeptide
WVSGINYNSGYKG

SEQ ID NO: 5661 - protein, 13 aa, Artificial Sequence
  synthetic polypeptide
WVSNINYNGGYKS

SEQ ID NO: 5662 - protein, 13 aa, Artificial Sequence
  synthetic polypeptide
WVAGINYNGGYTS

SEQ ID NO: 5663 - protein, 13 aa, Artificial Sequence
  synthetic polypeptide
WVASINYNGGYKG

SEQ ID NO: 5664 - protein, 13 aa, Artificial Sequence
  synthetic polypeptide
WVAGINYNGGYTS

SEQ ID NO: 5665 - protein, 13 aa, Artificial Sequence
  synthetic polypeptide
WVAGINYNSGYTS

SEQ ID NO: 5666 - protein, 13 aa, Artificial Sequence
  synthetic polypeptide
WVSGINYNSGYTS

SEQ ID NO: 5667 - protein, 13 aa, Artificial Sequence
  synthetic polypeptide
WVAGINYNGGYKG

SEQ ID NO: 5668 - protein, 13 aa, Artificial Sequence
  synthetic polypeptide
WVSGINYNSGYKS

SEQ ID NO: 5669 - protein, 13 aa, Artificial Sequence
  synthetic polypeptide
WVASINYNGGYKS

SEQ ID NO: 5670 - protein, 13 aa, Artificial Sequence
  synthetic polypeptide
WVSSINYNSGYTG

SEQ ID NO: 5671 - protein, 13 aa, Artificial Sequence
  synthetic polypeptide
WVSGINYNGGYTS

SEQ ID NO: 5672 - protein, 13 aa, Artificial Sequence
  synthetic polypeptide
WVSSINYNGGYTG

SEQ ID NO: 5673 - protein, 13 aa, Artificial Sequence
  synthetic polypeptide
WVAGINYNGGYTS

SEQ ID NO: 5674 - protein, 13 aa, Artificial Sequence
  synthetic polypeptide
WVAGINYNGGYTS

SEQ ID NO: 5675 - protein, 13 aa, Artificial Sequence
  synthetic polypeptide
WVSSINYNGGYTG

SEQ ID NO: 5676 - protein, 13 aa, Artificial Sequence
  synthetic polypeptide
WVAGINYNGGYTS

SEQ ID NO: 5677 - protein, 13 aa, Artificial Sequence
  synthetic polypeptide
WVSNINYNGGYKS

SEQ ID NO: 5678 - protein, 13 aa, Artificial Sequence
  synthetic polypeptide
WVASINYNSGYTG

SEQ ID NO: 5679 - protein, 13 aa, Artificial Sequence
  synthetic polypeptide
WVAGINYNSGYTS

SEQ ID NO: 5680 - protein, 13 aa, Artificial Sequence
  synthetic polypeptide
WVSSINYNGGYTG

SEQ ID NO: 5681 - protein, 13 aa, Artificial Sequence
  synthetic polypeptide
WVAGINYNSGYTS

SEQ ID NO: 5682 - protein, 13 aa, Artificial Sequence
  synthetic polypeptide
WVSGINYNGGYTG

SEQ ID NO: 5683 - protein, 13 aa, Artificial Sequence
  synthetic polypeptide
WVAGINYNGGYKS

SEQ ID NO: 5684 - protein, 13 aa, Artificial Sequence
  synthetic polypeptide
WVSNINYNGGYKG

SEQ ID NO: 5685 - protein, 13 aa, Artificial Sequence
  synthetic polypeptide
WVANINYNGGYKG

SEQ ID NO: 5686 - protein, 13 aa, Artificial Sequence
  synthetic polypeptide
WVSGINYNGGYTS

SEQ ID NO: 5687 - protein, 13 aa, Artificial Sequence
  synthetic polypeptide
WVAGINYNGGYTS

SEQ ID NO: 5688 - protein, 13 aa, Artificial Sequence
  synthetic polypeptide
WVSGINYNSGYTS

SEQ ID NO: 5689 - protein, 13 aa, Artificial Sequence
  synthetic polypeptide
WVAGINYNSGYTS

SEQ ID NO: 5690 - protein, 13 aa, Artificial Sequence
  synthetic polypeptide
WVANINYNGGYKS

SEQ ID NO: 5691 - protein, 13 aa, Artificial Sequence
  synthetic polypeptide
WVAGINYNGGYKG

SEQ ID NO: 5692 - protein, 13 aa, Artificial Sequence
  synthetic polypeptide
WVSGINYNGGYKS

SEQ ID NO: 5693 - protein, 13 aa, Artificial Sequence
  synthetic polypeptide
WVAGINYNGGYTS

SEQ ID NO: 5694 - protein, 13 aa, Artificial Sequence
  synthetic polypeptide
WVSGINYNGGYTS

SEQ ID NO: 5695 - protein, 13 aa, Artificial Sequence
  synthetic polypeptide
WVSGINYNGGYKS

SEQ ID NO: 5696 - protein, 13 aa, Artificial Sequence
  synthetic polypeptide
WVSNINYNGGYTS

SEQ ID NO: 5697 - protein, 13 aa, Artificial Sequence
  synthetic polypeptide
WVSGINYNGGYTS

SEQ ID NO: 5698 - protein, 13 aa, Artificial Sequence
  synthetic polypeptide
WVSGINYNSGYTS

SEQ ID NO: 5699 - protein, 13 aa, Artificial Sequence
  synthetic polypeptide
WVSSINYNGGYKG

SEQ ID NO: 5700 - protein, 13 aa, Artificial Sequence
  synthetic polypeptide
WVAGINYNGGYTG

SEQ ID NO: 5701 - protein, 13 aa, Artificial Sequence
  synthetic polypeptide
WVANINYNGGYTG

SEQ ID NO: 5702 - protein, 13 aa, Artificial Sequence
  synthetic polypeptide
WVSGINYNSGYTS

SEQ ID NO: 5703 - protein, 13 aa, Artificial Sequence
  synthetic polypeptide
WVSGINYNGGYKG

SEQ ID NO: 5704 - protein, 13 aa, Artificial Sequence
  synthetic polypeptide
WVSSINYNGGYTG

SEQ ID NO: 5705 - protein, 13 aa, Artificial Sequence
  synthetic polypeptide
WVSNINYNGGYKG

SEQ ID NO: 5706 - protein, 13 aa, Artificial Sequence
  synthetic polypeptide
WVSSINYNSGYKS

SEQ ID NO: 5707 - protein, 13 aa, Artificial Sequence
  synthetic polypeptide
WVSGINYNSGYTS

SEQ ID NO: 5708 - protein, 13 aa, Artificial Sequence
  synthetic polypeptide
WVAGINYNGGYKS

SEQ ID NO: 5709 - protein, 13 aa, Artificial Sequence
  synthetic polypeptide
WVSGINYNGGYKG

SEQ ID NO: 5710 - protein, 13 aa, Artificial Sequence
  synthetic polypeptide
WVASINYNGGYTS

SEQ ID NO: 5711 - protein, 13 aa, Artificial Sequence
  synthetic polypeptide
WVSGINYNGGYKS

SEQ ID NO: 5712 - protein, 13 aa, Artificial Sequence
  synthetic polypeptide
WVAGINYNSGYTG

SEQ ID NO: 5713 - protein, 13 aa, Artificial Sequence
  synthetic polypeptide
WVAGINYNSGYTS

SEQ ID NO: 5714 - protein, 13 aa, Artificial Sequence
  synthetic polypeptide
WVSSINYNGGYTG

SEQ ID NO: 5715 - protein, 13 aa, Artificial Sequence
  synthetic polypeptide
WVSGINYNSGYKG

SEQ ID NO: 5716 - protein, 13 aa, Artificial Sequence
  synthetic polypeptide
WVANINYNGGYTG

SEQ ID NO: 5717 - protein, 13 aa, Artificial Sequence
  synthetic polypeptide
WVAGINYNSGYKS

SEQ ID NO: 5718 - protein, 13 aa, Artificial Sequence
  synthetic polypeptide
WVAGINYNGGYKS

SEQ ID NO: 5719 - protein, 13 aa, Artificial Sequence
  synthetic polypeptide
WVAGINYNGGYTG

SEQ ID NO: 5720 - protein, 13 aa, Artificial Sequence
  synthetic polypeptide
WVSGINYNGGYTS

SEQ ID NO: 5721 - protein, 13 aa, Artificial Sequence
  synthetic polypeptide
WVAGINYNGGYTS

SEQ ID NO: 5722 - protein, 13 aa, Artificial Sequence
  synthetic polypeptide
WVAGINYNGGYTS

SEQ ID NO: 5723 - protein, 13 aa, Artificial Sequence
  synthetic polypeptide
WVSGINYNSGYTS

SEQ ID NO: 5724 - protein, 13 aa, Artificial Sequence
  synthetic polypeptide
WVSGINYNGGYTS

SEQ ID NO: 5725 - protein, 13 aa, Artificial Sequence
  synthetic polypeptide
WVASINYNGGYTS

SEQ ID NO: 5726 - protein, 13 aa, Artificial Sequence
  synthetic polypeptide
WVSGINYNGGYKS

SEQ ID NO: 5727 - protein, 13 aa, Artificial Sequence
  synthetic polypeptide
WVANINYNGGYTG

SEQ ID NO: 5728 - protein, 13 aa, Artificial Sequence
  synthetic polypeptide
WVSNINYNSGYTS

SEQ ID NO: 5729 - protein, 13 aa, Artificial Sequence
  synthetic polypeptide
WVSNINYNGGYTG

SEQ ID NO: 5730 - protein, 13 aa, Artificial Sequence
  synthetic polypeptide
WVSGINYNSGYKS

SEQ ID NO: 5731 - protein, 13 aa, Artificial Sequence
  synthetic polypeptide
WVSGINYNGGYTS

SEQ ID NO: 5732 - protein, 13 aa, Artificial Sequence
  synthetic polypeptide
WVASINYNGGYKG

SEQ ID NO: 5733 - protein, 13 aa, Artificial Sequence
  synthetic polypeptide
WVAGINYNSGYKS

SEQ ID NO: 5734 - protein, 13 aa, Artificial Sequence
  synthetic polypeptide
WVSGINYNSGYTS

SEQ ID NO: 5735 - protein, 13 aa, Artificial Sequence
  synthetic polypeptide
WVSGINYNGGYTS

SEQ ID NO: 5736 - protein, 13 aa, Artificial Sequence
  synthetic polypeptide
WVAGINYNSGYKS

SEQ ID NO: 5737 - protein, 13 aa, Artificial Sequence
  synthetic polypeptide
WVSGINYNGGYKG

SEQ ID NO: 5738 - protein, 13 aa, Artificial Sequence
  synthetic polypeptide
WVAGINYNGGYTG

SEQ ID NO: 5739 - protein, 13 aa, Artificial Sequence
  synthetic polypeptide
WVSNINYNGGYTG

SEQ ID NO: 5740 - protein, 13 aa, Artificial Sequence
  synthetic polypeptide
WVANINYNGGYTG

SEQ ID NO: 5741 - protein, 13 aa, Artificial Sequence
  synthetic polypeptide
WVSGINYNSGYKS

SEQ ID NO: 5742 - protein, 13 aa, Artificial Sequence
  synthetic polypeptide
WVAGINYNGGYTS

SEQ ID NO: 5743 - protein, 13 aa, Artificial Sequence
  synthetic polypeptide
WVANINYNGGYTG

SEQ ID NO: 5744 - protein, 13 aa, Artificial Sequence
  synthetic polypeptide
WVSSINYNGGYTS

SEQ ID NO: 5745 - protein, 13 aa, Artificial Sequence
  synthetic polypeptide
WVSNINYNGGYKS

SEQ ID NO: 5746 - protein, 13 aa, Artificial Sequence
  synthetic polypeptide
WVSGINYNGGYTS

SEQ ID NO: 5747 - protein, 13 aa, Artificial Sequence
  synthetic polypeptide
WVSGINYNGGYKS

SEQ ID NO: 5748 - protein, 13 aa, Artificial Sequence
  synthetic polypeptide
WVAGINYNSGYTS

SEQ ID NO: 5749 - protein, 13 aa, Artificial Sequence
  synthetic polypeptide
WVAGINYNGGYTS

SEQ ID NO: 5750 - protein, 13 aa, Artificial Sequence
  synthetic polypeptide
WVSGINYNGGYTS

SEQ ID NO: 5751 - protein, 13 aa, Artificial Sequence
  synthetic polypeptide
WVSSINYNSGYKG

SEQ ID NO: 5752 - protein, 13 aa, Artificial Sequence
  synthetic polypeptide
WVSGINYNGGYTS

SEQ ID NO: 5753 - protein, 13 aa, Artificial Sequence
  synthetic polypeptide
WVSGINYNGGYTS

SEQ ID NO: 5754 - protein, 13 aa, Artificial Sequence
  synthetic polypeptide
WVSGINYNSGYTS

SEQ ID NO: 5755 - protein, 13 aa, Artificial Sequence
  synthetic polypeptide
WVSNINYNGGYTG

SEQ ID NO: 5756 - protein, 13 aa, Artificial Sequence
  synthetic polypeptide
WVSNINYNGGYTS

SEQ ID NO: 5757 - protein, 13 aa, Artificial Sequence
  synthetic polypeptide
WVSGINYNSGYKS

SEQ ID NO: 5758 - protein, 13 aa, Artificial Sequence
  synthetic polypeptide
WVAGINYNGGYTS

SEQ ID NO: 5759 - protein, 13 aa, Artificial Sequence
  synthetic polypeptide
WVASINYNSGYKS

SEQ ID NO: 5760 - protein, 13 aa, Artificial Sequence
  synthetic polypeptide
WVSSINYNSGYTS

SEQ ID NO: 5761 - protein, 13 aa, Artificial Sequence
  synthetic polypeptide
WVSSINYNGGYKG

SEQ ID NO: 5762 - protein, 13 aa, Artificial Sequence
  synthetic polypeptide
WVSGINYNGGYTS

SEQ ID NO: 5763 - protein, 13 aa, Artificial Sequence
  synthetic polypeptide
WVSGINYNSGYTS

SEQ ID NO: 5764 - protein, 13 aa, Artificial Sequence
  synthetic polypeptide
WVAGINYNGGYTS

SEQ ID NO: 5765 - protein, 13 aa, Artificial Sequence
  synthetic polypeptide
WVSSINYNSGYTS

SEQ ID NO: 5766 - protein, 13 aa, Artificial Sequence
  synthetic polypeptide
WVSGINYNSGYKS

SEQ ID NO: 5767 - protein, 13 aa, Artificial Sequence
  synthetic polypeptide
WVSSINYNGGYKG

SEQ ID NO: 5768 - protein, 13 aa, Artificial Sequence
  synthetic polypeptide
WVAGINYNGGYKS

SEQ ID NO: 5769 - protein, 13 aa, Artificial Sequence
  synthetic polypeptide
WVAGINYNGGYKS

SEQ ID NO: 5770 - protein, 13 aa, Artificial Sequence
  synthetic polypeptide
WVSGINYNSGYTG

SEQ ID NO: 5771 - protein, 13 aa, Artificial Sequence
  synthetic polypeptide
WVSGINYNGGYTS

SEQ ID NO: 5772 - protein, 13 aa, Artificial Sequence
  synthetic polypeptide
WVSGINYNSGYKS

SEQ ID NO: 5773 - protein, 13 aa, Artificial Sequence
  synthetic polypeptide
WVASINYNGGYTS

SEQ ID NO: 5774 - protein, 13 aa, Artificial Sequence
  synthetic polypeptide
WVSGINYNGGYKS

SEQ ID NO: 5775 - protein, 13 aa, Artificial Sequence
  synthetic polypeptide
WVSGINYNGGYKS

SEQ ID NO: 5776 - protein, 13 aa, Artificial Sequence
  synthetic polypeptide
WVSGINYNGGYTS

SEQ ID NO: 5777 - protein, 13 aa, Artificial Sequence
  synthetic polypeptide
WVASINYNGGYTG

SEQ ID NO: 5778 - protein, 13 aa, Artificial Sequence
  synthetic polypeptide
WVSGINYNGGYKS

SEQ ID NO: 5779 - protein, 13 aa, Artificial Sequence
  synthetic polypeptide
WVSGINYNGGYTS

SEQ ID NO: 5780 - protein, 13 aa, Artificial Sequence
  synthetic polypeptide
WVSGINYNGGYTS

SEQ ID NO: 5781 - protein, 13 aa, Artificial Sequence
  synthetic polypeptide
WVAGINYNGGYKG

SEQ ID NO: 5782 - protein, 13 aa, Artificial Sequence
  synthetic polypeptide
WVSSINYNSGYTS

SEQ ID NO: 5783 - protein, 13 aa, Artificial Sequence
  synthetic polypeptide
WVSGINYNGGYTS

SEQ ID NO: 5784 - protein, 13 aa, Artificial Sequence
  synthetic polypeptide
WVAGINYNGGYTS

SEQ ID NO: 5785 - protein, 13 aa, Artificial Sequence
  synthetic polypeptide
WVSGINYNGGYTS

SEQ ID NO: 5786 - protein, 13 aa, Artificial Sequence
  synthetic polypeptide
WVAGINYNGGYTS

SEQ ID NO: 5787 - protein, 13 aa, Artificial Sequence
  synthetic polypeptide
WVSSINYNSGYTG

SEQ ID NO: 5788 - protein, 13 aa, Artificial Sequence
  synthetic polypeptide
WVAGINYNGGYTG

SEQ ID NO: 5789 - protein, 13 aa, Artificial Sequence
  synthetic polypeptide
WVSGINYNSGYKS

SEQ ID NO: 5790 - protein, 13 aa, Artificial Sequence
  synthetic polypeptide
WVAGINYNGGYKS

SEQ ID NO: 5791 - protein, 13 aa, Artificial Sequence
  synthetic polypeptide
WVAGINYNGGYTS

SEQ ID NO: 5792 - protein, 13 aa, Artificial Sequence
  synthetic polypeptide
WVSGINYNGGYTG

SEQ ID NO: 5793 - protein, 13 aa, Artificial Sequence
  synthetic polypeptide
WVAGINYNGGYTS

SEQ ID NO: 5794 - protein, 13 aa, Artificial Sequence
  synthetic polypeptide
WVAGINYNGGYTS

SEQ ID NO: 5795 - protein, 13 aa, Artificial Sequence
  synthetic polypeptide
WVANINYNGGYTG

SEQ ID NO: 5796 - protein, 13 aa, Artificial Sequence
  synthetic polypeptide
WVAGINYNGGYTS

SEQ ID NO: 5797 - protein, 13 aa, Artificial Sequence
  synthetic polypeptide
WVSGINYNGGYKS

SEQ ID NO: 5798 - protein, 13 aa, Artificial Sequence
  synthetic polypeptide
WVSGINYNGGYTS

SEQ ID NO: 5799 - protein, 13 aa, Artificial Sequence
  synthetic polypeptide
WVASINYNSGYTS

SEQ ID NO: 5800 - protein, 13 aa, Artificial Sequence
  synthetic polypeptide
WVSNINYNGGYTG

SEQ ID NO: 5801 - protein, 13 aa, Artificial Sequence
  synthetic polypeptide
WVSSINYNSGYKS

SEQ ID NO: 5802 - protein, 13 aa, Artificial Sequence
  synthetic polypeptide
WVASINYNSGYTG

SEQ ID NO: 5803 - protein, 13 aa, Artificial Sequence
  synthetic polypeptide
WVAGINYNGGYTS

SEQ ID NO: 5804 - protein, 13 aa, Artificial Sequence
  synthetic polypeptide
WVSNINYNGGYTG

SEQ ID NO: 5805 - protein, 13 aa, Artificial Sequence
  synthetic polypeptide
WVAGINYNGGYTS

SEQ ID NO: 5806 - protein, 13 aa, Artificial Sequence
  synthetic polypeptide
WVAGINYNGGYTG

SEQ ID NO: 5807 - protein, 13 aa, Artificial Sequence
  synthetic polypeptide
WVAGINYNSGYKS

SEQ ID NO: 5808 - protein, 13 aa, Artificial Sequence
  synthetic polypeptide
WVAGINYNGGYKG

SEQ ID NO: 5809 - protein, 13 aa, Artificial Sequence
  synthetic polypeptide
WVSNINYNGGYTG

SEQ ID NO: 5810 - protein, 13 aa, Artificial Sequence
  synthetic polypeptide
WVAGINYNSGYTG

SEQ ID NO: 5811 - protein, 13 aa, Artificial Sequence
  synthetic polypeptide
WVSGINYNGGYTS

SEQ ID NO: 5812 - protein, 13 aa, Artificial Sequence
  synthetic polypeptide
WVAGINYNGGYKG

SEQ ID NO: 5813 - protein, 13 aa, Artificial Sequence
  synthetic polypeptide
WVSGINYNGGYTS

SEQ ID NO: 5814 - protein, 13 aa, Artificial Sequence
  synthetic polypeptide
WVAGINYNGGYKS

SEQ ID NO: 5815 - protein, 13 aa, Artificial Sequence
  synthetic polypeptide
WVSGINYNGGYTG

SEQ ID NO: 5816 - protein, 13 aa, Artificial Sequence
  synthetic polypeptide
WVAGINYNGGYTS

SEQ ID NO: 5817 - protein, 13 aa, Artificial Sequence
  synthetic polypeptide
WVAGINYNGGYTG

SEQ ID NO: 5818 - protein, 13 aa, Artificial Sequence
  synthetic polypeptide
WVAGINYNGGYTS

SEQ ID NO: 5819 - protein, 13 aa, Artificial Sequence
  synthetic polypeptide
WVAGINYNGGYKG

SEQ ID NO: 5820 - protein, 13 aa, Artificial Sequence
  synthetic polypeptide
WVAGINYNGGYKG

SEQ ID NO: 5821 - protein, 13 aa, Artificial Sequence
  synthetic polypeptide
WVSNINYNGGYTG

SEQ ID NO: 5822 - protein, 12 aa, Artificial Sequence
  synthetic polypeptide
ARGANWHDTHLD

SEQ ID NO: 5823 - protein, 12 aa, Artificial Sequence
  synthetic polypeptide
ARGANWHDTHLD

SEQ ID NO: 5824 - protein, 12 aa, Artificial Sequence
  synthetic polypeptide
ARGANWHDTALD

SEQ ID NO: 5825 - protein, 12 aa, Artificial Sequence
  synthetic polypeptide
ARGANWHDTHLD

SEQ ID NO: 5826 - protein, 12 aa, Artificial Sequence
  synthetic polypeptide
ARGANWHDTHLD

SEQ ID NO: 5827 - protein, 12 aa, Artificial Sequence
  synthetic polypeptide
ARGANWHDTHLD

SEQ ID NO: 5828 - protein, 12 aa, Artificial Sequence
  synthetic polypeptide
ARGANWHDTHLD

SEQ ID NO: 5829 - protein, 12 aa, Artificial Sequence
  synthetic polypeptide
ARGANWHDTALD

SEQ ID NO: 5830 - protein, 12 aa, Artificial Sequence
  synthetic polypeptide
ARGANWHDTHLD

SEQ ID NO: 5831 - protein, 12 aa, Artificial Sequence
  synthetic polypeptide
ARGANWHDTHLD

SEQ ID NO: 5832 - protein, 12 aa, Artificial Sequence
  synthetic polypeptide
ARGANWHDTHLD

SEQ ID NO: 5833 - protein, 12 aa, Artificial Sequence
  synthetic polypeptide
ARGANWHDTHLD

SEQ ID NO: 5834 - protein, 12 aa, Artificial Sequence
  synthetic polypeptide
ARGANWHDTALD

SEQ ID NO: 5835 - protein, 12 aa, Artificial Sequence
  synthetic polypeptide
ARGANWHDTHLD

SEQ ID NO: 5836 - protein, 12 aa, Artificial Sequence
  synthetic polypeptide
ARGANWHDTHLD

SEQ ID NO: 5837 - protein, 12 aa, Artificial Sequence
  synthetic polypeptide
ARGANWHDTHLD

SEQ ID NO: 5838 - protein, 12 aa, Artificial Sequence
  synthetic polypeptide
ARGANWHDTHLD

SEQ ID NO: 5839 - protein, 12 aa, Artificial Sequence
  synthetic polypeptide
ARGANWHDTHLD

SEQ ID NO: 5840 - protein, 12 aa, Artificial Sequence
  synthetic polypeptide
ARGANWHDTHLD

SEQ ID NO: 5841 - protein, 12 aa, Artificial Sequence
  synthetic polypeptide
ARGANWHDTALD

SEQ ID NO: 5842 - protein, 12 aa, Artificial Sequence
  synthetic polypeptide
ARGANWHDTHLD

SEQ ID NO: 5843 - protein, 12 aa, Artificial Sequence
  synthetic polypeptide
ARGANWHDTHLD

SEQ ID NO: 5844 - protein, 12 aa, Artificial Sequence
  synthetic polypeptide
ARGANWHDTHLD

SEQ ID NO: 5845 - protein, 12 aa, Artificial Sequence
  synthetic polypeptide
ARGANWHDTHLD

SEQ ID NO: 5846 - protein, 12 aa, Artificial Sequence
  synthetic polypeptide
ARGANWHDTALD

SEQ ID NO: 5847 - protein, 12 aa, Artificial Sequence
  synthetic polypeptide
ARGANWHDTHLD

SEQ ID NO: 5848 - protein, 12 aa, Artificial Sequence
  synthetic polypeptide
ARGANWHDTHLD

SEQ ID NO: 5849 - protein, 12 aa, Artificial Sequence
  synthetic polypeptide
ARGANWHDTHLD

SEQ ID NO: 5850 - protein, 12 aa, Artificial Sequence
  synthetic polypeptide
ARGANWHDTALD

SEQ ID NO: 5851 - protein, 12 aa, Artificial Sequence
  synthetic polypeptide
ARGANWHDTHLD

SEQ ID NO: 5852 - protein, 12 aa, Artificial Sequence
  synthetic polypeptide
ARGANWHDTHLD

SEQ ID NO: 5853 - protein, 12 aa, Artificial Sequence
  synthetic polypeptide
ARGANWHDTHLD

SEQ ID NO: 5854 - protein, 12 aa, Artificial Sequence
  synthetic polypeptide
ARGANWHDTHLD

SEQ ID NO: 5855 - protein, 12 aa, Artificial Sequence
  synthetic polypeptide
ARGANWHDTHLD

SEQ ID NO: 5856 - protein, 12 aa, Artificial Sequence
  synthetic polypeptide
ARGANWHDTHLD

SEQ ID NO: 5857 - protein, 12 aa, Artificial Sequence
  synthetic polypeptide
ARGANWHDTHLD

SEQ ID NO: 5858 - protein, 12 aa, Artificial Sequence
  synthetic polypeptide
ARGANWHDTHLD

SEQ ID NO: 5859 - protein, 12 aa, Artificial Sequence
  synthetic polypeptide
ARGANWHDTHLD

SEQ ID NO: 5860 - protein, 12 aa, Artificial Sequence
  synthetic polypeptide
ARGANWHDTHLD

SEQ ID NO: 5861 - protein, 12 aa, Artificial Sequence
  synthetic polypeptide
ARGANWHDTHLD

SEQ ID NO: 5862 - protein, 12 aa, Artificial Sequence
  synthetic polypeptide
ARGANWHDTHLD

SEQ ID NO: 5863 - protein, 12 aa, Artificial Sequence
  synthetic polypeptide
ARGANWHDTHLD

SEQ ID NO: 5864 - protein, 12 aa, Artificial Sequence
  synthetic polypeptide
ARGANWHDTHLD

SEQ ID NO: 5865 - protein, 12 aa, Artificial Sequence
  synthetic polypeptide
ARGANWHDTHLD

SEQ ID NO: 5866 - protein, 12 aa, Artificial Sequence
  synthetic polypeptide
ARGANWHDTHLD

SEQ ID NO: 5867 - protein, 12 aa, Artificial Sequence
  synthetic polypeptide
ARGANWHDTHLD

SEQ ID NO: 5868 - protein, 12 aa, Artificial Sequence
  synthetic polypeptide
ARGANWHDTALD

SEQ ID NO: 5869 - protein, 12 aa, Artificial Sequence
  synthetic polypeptide
ARGANWHDTHLD

SEQ ID NO: 5870 - protein, 12 aa, Artificial Sequence
  synthetic polypeptide
ARGANWHDTALD

SEQ ID NO: 5871 - protein, 12 aa, Artificial Sequence
  synthetic polypeptide
ARGANWHDTHLD

SEQ ID NO: 5872 - protein, 12 aa, Artificial Sequence
  synthetic polypeptide
ARGANWHDTALD

SEQ ID NO: 5873 - protein, 12 aa, Artificial Sequence
  synthetic polypeptide
ARGANWHDTHLD

SEQ ID NO: 5874 - protein, 12 aa, Artificial Sequence
  synthetic polypeptide
ARGANWHDTHLD

SEQ ID NO: 5875 - protein, 12 aa, Artificial Sequence
  synthetic polypeptide
ARGANWHDTALD

SEQ ID NO: 5876 - protein, 12 aa, Artificial Sequence
  synthetic polypeptide
ARGANWHDTALD

SEQ ID NO: 5877 - protein, 12 aa, Artificial Sequence
  synthetic polypeptide
ARGANWHDTALD

SEQ ID NO: 5878 - protein, 12 aa, Artificial Sequence
  synthetic polypeptide
ARGANWHDTHLD

SEQ ID NO: 5879 - protein, 12 aa, Artificial Sequence
  synthetic polypeptide
ARGANWHDTALD

SEQ ID NO: 5880 - protein, 12 aa, Artificial Sequence
  synthetic polypeptide
ARGANWHDTALD

SEQ ID NO: 5881 - protein, 12 aa, Artificial Sequence
  synthetic polypeptide
ARGANWHDTHLD

SEQ ID NO: 5882 - protein, 12 aa, Artificial Sequence
  synthetic polypeptide
ARGANWHDTALD

SEQ ID NO: 5883 - protein, 12 aa, Artificial Sequence
  synthetic polypeptide
ARGANWHDTALD

SEQ ID NO: 5884 - protein, 12 aa, Artificial Sequence
  synthetic polypeptide
ARGANWHDTALD

SEQ ID NO: 5885 - protein, 12 aa, Artificial Sequence
  synthetic polypeptide
ARGANWHDTALD

SEQ ID NO: 5886 - protein, 12 aa, Artificial Sequence
  synthetic polypeptide
ARGANWHDTHLD

SEQ ID NO: 5887 - protein, 12 aa, Artificial Sequence
  synthetic polypeptide
ARGANWHDTALD

SEQ ID NO: 5888 - protein, 12 aa, Artificial Sequence
  synthetic polypeptide
ARGANWHDTALD

SEQ ID NO: 5889 - protein, 12 aa, Artificial Sequence
  synthetic polypeptide
ARGANWHDTHLD

SEQ ID NO: 5890 - protein, 12 aa, Artificial Sequence
  synthetic polypeptide
ARGANWHDTALD

SEQ ID NO: 5891 - protein, 12 aa, Artificial Sequence
  synthetic polypeptide
ARGANWHDTHLD

SEQ ID NO: 5892 - protein, 12 aa, Artificial Sequence
  synthetic polypeptide
ARGANWHDTALD

SEQ ID NO: 5893 - protein, 12 aa, Artificial Sequence
  synthetic polypeptide
ARGANWHDTHLD

SEQ ID NO: 5894 - protein, 12 aa, Artificial Sequence
  synthetic polypeptide
ARGANWHDTALD

SEQ ID NO: 5895 - protein, 12 aa, Artificial Sequence
  synthetic polypeptide
ARGANWHDTALD

SEQ ID NO: 5896 - protein, 12 aa, Artificial Sequence
  synthetic polypeptide
ARGANWHDTHLD

SEQ ID NO: 5897 - protein, 12 aa, Artificial Sequence
  synthetic polypeptide
ARGANWHDTALD

SEQ ID NO: 5898 - protein, 12 aa, Artificial Sequence
  synthetic polypeptide
ARGANWHDTHLD

SEQ ID NO: 5899 - protein, 12 aa, Artificial Sequence
  synthetic polypeptide
ARGANWHDTALD

SEQ ID NO: 5900 - protein, 12 aa, Artificial Sequence
  synthetic polypeptide
ARGANWHDTALD

SEQ ID NO: 5901 - protein, 12 aa, Artificial Sequence
  synthetic polypeptide
ARGANWHDTALD

SEQ ID NO: 5902 - protein, 12 aa, Artificial Sequence
  synthetic polypeptide
ARGANWHDTALD

SEQ ID NO: 5903 - protein, 12 aa, Artificial Sequence
  synthetic polypeptide
ARGANWHDTALD

SEQ ID NO: 5904 - protein, 12 aa, Artificial Sequence
  synthetic polypeptide
ARGANWHDTHLD

SEQ ID NO: 5905 - protein, 12 aa, Artificial Sequence
  synthetic polypeptide
ARGANWHDTALD

SEQ ID NO: 5906 - protein, 12 aa, Artificial Sequence
  synthetic polypeptide
ARGANWHDTALD

SEQ ID NO: 5907 - protein, 12 aa, Artificial Sequence
  synthetic polypeptide
ARGANWHDTALD

SEQ ID NO: 5908 - protein, 12 aa, Artificial Sequence
  synthetic polypeptide
ARGANWHDTALD

SEQ ID NO: 5909 - protein, 12 aa, Artificial Sequence
  synthetic polypeptide
ARGANWHDTALD

SEQ ID NO: 5910 - protein, 12 aa, Artificial Sequence
  synthetic polypeptide
ARGANWHDTALD

SEQ ID NO: 5911 - protein, 12 aa, Artificial Sequence
  synthetic polypeptide
ARGANWHDTHLD

SEQ ID NO: 5912 - protein, 12 aa, Artificial Sequence
  synthetic polypeptide
ARGANWHDTHLD

SEQ ID NO: 5913 - protein, 12 aa, Artificial Sequence
  synthetic polypeptide
ARGANWHDTALD

SEQ ID NO: 5914 - protein, 12 aa, Artificial Sequence
  synthetic polypeptide
ARGANWHDTALD

SEQ ID NO: 5915 - protein, 12 aa, Artificial Sequence
  synthetic polypeptide
ARGANWHDTALD

SEQ ID NO: 5916 - protein, 12 aa, Artificial Sequence
  synthetic polypeptide
ARGANWHDTALD

SEQ ID NO: 5917 - protein, 12 aa, Artificial Sequence
  synthetic polypeptide
ARGANWHDTHLD

SEQ ID NO: 5918 - protein, 12 aa, Artificial Sequence
  synthetic polypeptide
ARGANWHDTHLD

SEQ ID NO: 5919 - protein, 12 aa, Artificial Sequence
  synthetic polypeptide
ARGANWHDTALD

SEQ ID NO: 5920 - protein, 12 aa, Artificial Sequence
  synthetic polypeptide
ARGANWHDTHLD

SEQ ID NO: 5921 - protein, 12 aa, Artificial Sequence
  synthetic polypeptide
ARGANWHDTALD

SEQ ID NO: 5922 - protein, 12 aa, Artificial Sequence
  synthetic polypeptide
ARGANWHDTALD

SEQ ID NO: 5923 - protein, 12 aa, Artificial Sequence
  synthetic polypeptide
ARGANWHDTALD

SEQ ID NO: 5924 - protein, 12 aa, Artificial Sequence
  synthetic polypeptide
ARGANWHDTALD

SEQ ID NO: 5925 - protein, 12 aa, Artificial Sequence
  synthetic polypeptide
ARGANWHDTALD

SEQ ID NO: 5926 - protein, 12 aa, Artificial Sequence
  synthetic polypeptide
ARGANWHDTALD

SEQ ID NO: 5927 - protein, 12 aa, Artificial Sequence
  synthetic polypeptide
ARGANWHDTHLD

SEQ ID NO: 5928 - protein, 12 aa, Artificial Sequence
  synthetic polypeptide
ARGANWHDTALD

SEQ ID NO: 5929 - protein, 12 aa, Artificial Sequence
  synthetic polypeptide
ARGANWHDTALD

SEQ ID NO: 5930 - protein, 12 aa, Artificial Sequence
  synthetic polypeptide
ARGANWHDTHLD

SEQ ID NO: 5931 - protein, 12 aa, Artificial Sequence
  synthetic polypeptide
ARGANWHDTALD

SEQ ID NO: 5932 - protein, 12 aa, Artificial Sequence
  synthetic polypeptide
ARGANWHDTALD

SEQ ID NO: 5933 - protein, 12 aa, Artificial Sequence
  synthetic polypeptide
ARGANWHDTHLD

SEQ ID NO: 5934 - protein, 12 aa, Artificial Sequence
  synthetic polypeptide
ARGANWHDTALD

SEQ ID NO: 5935 - protein, 12 aa, Artificial Sequence
  synthetic polypeptide
ARGANWHDTALD

SEQ ID NO: 5936 - protein, 12 aa, Artificial Sequence
  synthetic polypeptide
ARGANWHDTALD

SEQ ID NO: 5937 - protein, 12 aa, Artificial Sequence
  synthetic polypeptide
ARGANWHDTHLD

SEQ ID NO: 5938 - protein, 12 aa, Artificial Sequence
  synthetic polypeptide
ARGANWHDTHLD

SEQ ID NO: 5939 - protein, 12 aa, Artificial Sequence
  synthetic polypeptide
ARGANWHDTHLD

SEQ ID NO: 5940 - protein, 12 aa, Artificial Sequence
  synthetic polypeptide
ARGANWHDTHLD

SEQ ID NO: 5941 - protein, 12 aa, Artificial Sequence
  synthetic polypeptide
ARGANWHDTALD

SEQ ID NO: 5942 - protein, 12 aa, Artificial Sequence
  synthetic polypeptide
ARGANWHDTALD

SEQ ID NO: 5943 - protein, 12 aa, Artificial Sequence
  synthetic polypeptide
ARGANWHDTALD

SEQ ID NO: 5944 - protein, 12 aa, Artificial Sequence
  synthetic polypeptide
ARGANWHDTHLD

SEQ ID NO: 5945 - protein, 12 aa, Artificial Sequence
  synthetic polypeptide
ARGANWHDTALD

SEQ ID NO: 5946 - protein, 12 aa, Artificial Sequence
  synthetic polypeptide
ARGANWHDTHLD

SEQ ID NO: 5947 - protein, 12 aa, Artificial Sequence
  synthetic polypeptide
ARGANWHDTALD

SEQ ID NO: 5948 - protein, 12 aa, Artificial Sequence
  synthetic polypeptide
ARGANWHDTHLD

SEQ ID NO: 5949 - protein, 12 aa, Artificial Sequence
  synthetic polypeptide
ARGANWHDTHLD

SEQ ID NO: 5950 - protein, 12 aa, Artificial Sequence
  synthetic polypeptide
ARGANWHDTALD

SEQ ID NO: 5951 - protein, 12 aa, Artificial Sequence
  synthetic polypeptide
ARGANWHDTALD

SEQ ID NO: 5952 - protein, 12 aa, Artificial Sequence
  synthetic polypeptide
ARGANWHDTHLD

SEQ ID NO: 5953 - protein, 12 aa, Artificial Sequence
  synthetic polypeptide
ARGANWHDTALD

SEQ ID NO: 5954 - protein, 12 aa, Artificial Sequence
  synthetic polypeptide
ARGANWHDTALD

SEQ ID NO: 5955 - protein, 12 aa, Artificial Sequence
  synthetic polypeptide
ARGANWHDTALD

SEQ ID NO: 5956 - protein, 12 aa, Artificial Sequence
  synthetic polypeptide
ARGANWHDTHLD

SEQ ID NO: 5957 - protein, 12 aa, Artificial Sequence
  synthetic polypeptide
ARGANWHDTALD

SEQ ID NO: 5958 - protein, 12 aa, Artificial Sequence
  synthetic polypeptide
ARGANWHDTALD

SEQ ID NO: 5959 - protein, 12 aa, Artificial Sequence
  synthetic polypeptide
ARGANWHDTALD

SEQ ID NO: 5960 - protein, 12 aa, Artificial Sequence
  synthetic polypeptide
ARGANWHDTHLD

SEQ ID NO: 5961 - protein, 12 aa, Artificial Sequence
  synthetic polypeptide
ARGANWHDTHLD

SEQ ID NO: 5962 - protein, 12 aa, Artificial Sequence
  synthetic polypeptide
ARGANWHDTALD

SEQ ID NO: 5963 - protein, 12 aa, Artificial Sequence
  synthetic polypeptide
ARGANWHDTHLD

SEQ ID NO: 5964 - protein, 12 aa, Artificial Sequence
  synthetic polypeptide
ARGANWHDTALD

SEQ ID NO: 5965 - protein, 12 aa, Artificial Sequence
  synthetic polypeptide
ARGANWHDTALD

SEQ ID NO: 5966 - protein, 12 aa, Artificial Sequence
  synthetic polypeptide
ARGANWHDTHLD

SEQ ID NO: 5967 - protein, 12 aa, Artificial Sequence
  synthetic polypeptide
ARGANWHDTALD

SEQ ID NO: 5968 - protein, 12 aa, Artificial Sequence
  synthetic polypeptide
ARGANWHDTALD

SEQ ID NO: 5969 - protein, 12 aa, Artificial Sequence
  synthetic polypeptide
ARGANWHDTALD

SEQ ID NO: 5970 - protein, 12 aa, Artificial Sequence
  synthetic polypeptide
ARGANWHDTALD

SEQ ID NO: 5971 - protein, 12 aa, Artificial Sequence
  synthetic polypeptide
ARGANWHDTALD

SEQ ID NO: 5972 - protein, 12 aa, Artificial Sequence
  synthetic polypeptide
ARGANWHDTALD

SEQ ID NO: 5973 - protein, 12 aa, Artificial Sequence
  synthetic polypeptide
ARGANWHDTALD

SEQ ID NO: 5974 - protein, 12 aa, Artificial Sequence
  synthetic polypeptide
ARGANWHDTHLD

SEQ ID NO: 5975 - protein, 12 aa, Artificial Sequence
  synthetic polypeptide
ARGANWHDTALD

SEQ ID NO: 5976 - protein, 12 aa, Artificial Sequence
  synthetic polypeptide
ARGANWHDTALD

SEQ ID NO: 5977 - protein, 12 aa, Artificial Sequence
  synthetic polypeptide
ARGANWHDTALD

SEQ ID NO: 5978 - protein, 12 aa, Artificial Sequence
  synthetic polypeptide
ARGANWHDTHLD

SEQ ID NO: 5979 - protein, 12 aa, Artificial Sequence
  synthetic polypeptide
ARGANWHDTALD

SEQ ID NO: 5980 - protein, 12 aa, Artificial Sequence
  synthetic polypeptide
ARGANWHDTHLD

SEQ ID NO: 5981 - protein, 12 aa, Artificial Sequence
  synthetic polypeptide
ARGANWHDTHLD

SEQ ID NO: 5982 - protein, 12 aa, Artificial Sequence
  synthetic polypeptide
ARGANWHDTALD

SEQ ID NO: 5983 - protein, 12 aa, Artificial Sequence
  synthetic polypeptide
ARGANWHDTALD

SEQ ID NO: 5984 - protein, 12 aa, Artificial Sequence
  synthetic polypeptide
ARGANWHDTALD

SEQ ID NO: 5985 - protein, 12 aa, Artificial Sequence
  synthetic polypeptide
ARGANWHDTALD

SEQ ID NO: 5986 - protein, 12 aa, Artificial Sequence
  synthetic polypeptide
ARGANWHDTALD

SEQ ID NO: 5987 - protein, 12 aa, Artificial Sequence
  synthetic polypeptide
ARGANWHDTALD

SEQ ID NO: 5988 - protein, 12 aa, Artificial Sequence
  synthetic polypeptide
ARGANWHDTALD

SEQ ID NO: 5989 - protein, 12 aa, Artificial Sequence
  synthetic polypeptide
ARGANWHDTHLD

SEQ ID NO: 5990 - protein, 12 aa, Artificial Sequence
  synthetic polypeptide
ARGANWHDTHLD

SEQ ID NO: 5991 - protein, 12 aa, Artificial Sequence
  synthetic polypeptide
ARGANWHDTALD

SEQ ID NO: 5992 - protein, 12 aa, Artificial Sequence
  synthetic polypeptide
ARGANWHDTALD

SEQ ID NO: 5993 - protein, 12 aa, Artificial Sequence
  synthetic polypeptide
ARGANWHDTALD

SEQ ID NO: 5994 - protein, 12 aa, Artificial Sequence
  synthetic polypeptide
ARGANWHDTHLD

SEQ ID NO: 5995 - protein, 12 aa, Artificial Sequence
  synthetic polypeptide
ARGANWHDTALD

SEQ ID NO: 5996 - protein, 12 aa, Artificial Sequence
  synthetic polypeptide
ARGANWHDTHLD

SEQ ID NO: 5997 - protein, 12 aa, Artificial Sequence
  synthetic polypeptide
ARGANWHDTALD

SEQ ID NO: 5998 - protein, 12 aa, Artificial Sequence
  synthetic polypeptide
ARGANWHDTALD

SEQ ID NO: 5999 - protein, 12 aa, Artificial Sequence
  synthetic polypeptide
ARGANWHDTALD

SEQ ID NO: 6000 - protein, 12 aa, Artificial Sequence
  synthetic polypeptide
ARGANWHDTALD

SEQ ID NO: 6001 - protein, 7 aa, Artificial Sequence
  synthetic polypeptide
LTYLNWY

SEQ ID NO: 6002 - protein, 7 aa, Artificial Sequence
  synthetic polypeptide
SSYLNWY

SEQ ID NO: 6003 - protein, 7 aa, Artificial Sequence
  synthetic polypeptide
LTYLNWY

SEQ ID NO: 6004 - protein, 7 aa, Artificial Sequence
  synthetic polypeptide
LTYVNWY

SEQ ID NO: 6005 - protein, 7 aa, Artificial Sequence
  synthetic polypeptide
LSYLNWY

SEQ ID NO: 6006 - protein, 7 aa, Artificial Sequence
  synthetic polypeptide
VSYLNWY

SEQ ID NO: 6007 - protein, 7 aa, Artificial Sequence
  synthetic polypeptide
VSYVNWY

SEQ ID NO: 6008 - protein, 7 aa, Artificial Sequence
  synthetic polypeptide
LSYLNWY

SEQ ID NO: 6009 - protein, 7 aa, Artificial Sequence
  synthetic polypeptide
ITYLNWY

SEQ ID NO: 6010 - protein, 7 aa, Artificial Sequence
  synthetic polypeptide
STYVNWY

SEQ ID NO: 6011 - protein, 7 aa, Artificial Sequence
  synthetic polypeptide
SSYLNWY

SEQ ID NO: 6012 - protein, 7 aa, Artificial Sequence
  synthetic polypeptide
VSYVNWY

SEQ ID NO: 6013 - protein, 7 aa, Artificial Sequence
  synthetic polypeptide
SSYLNWY

SEQ ID NO: 6014 - protein, 7 aa, Artificial Sequence
  synthetic polypeptide
VSYLNWY

SEQ ID NO: 6015 - protein, 7 aa, Artificial Sequence
  synthetic polypeptide
LTYLNWY

SEQ ID NO: 6016 - protein, 7 aa, Artificial Sequence
  synthetic polypeptide
VTYLNWY

SEQ ID NO: 6017 - protein, 7 aa, Artificial Sequence
  synthetic polypeptide
LTYLNWY

SEQ ID NO: 6018 - protein, 7 aa, Artificial Sequence
  synthetic polypeptide
LSYLNWY

SEQ ID NO: 6019 - protein, 7 aa, Artificial Sequence
  synthetic polypeptide
LTYLNWY

SEQ ID NO: 6020 - protein, 7 aa, Artificial Sequence
  synthetic polypeptide
LTYVNWY

SEQ ID NO: 6021 - protein, 7 aa, Artificial Sequence
  synthetic polypeptide
LSYVNWY

SEQ ID NO: 6022 - protein, 7 aa, Artificial Sequence
  synthetic polypeptide
LTYLNWY

SEQ ID NO: 6023 - protein, 7 aa, Artificial Sequence
  synthetic polypeptide
ITYVNWY

SEQ ID NO: 6024 - protein, 7 aa, Artificial Sequence
  synthetic polypeptide
LSYLNWY

SEQ ID NO: 6025 - protein, 7 aa, Artificial Sequence
  synthetic polypeptide
SSYVNWY

SEQ ID NO: 6026 - protein, 7 aa, Artificial Sequence
  synthetic polypeptide
LSYLNWY

SEQ ID NO: 6027 - protein, 7 aa, Artificial Sequence
  synthetic polypeptide
LSYVNWY

SEQ ID NO: 6028 - protein, 7 aa, Artificial Sequence
  synthetic polypeptide
LTYVNWY

SEQ ID NO: 6029 - protein, 7 aa, Artificial Sequence
  synthetic polypeptide
VSYVNWY

SEQ ID NO: 6030 - protein, 7 aa, Artificial Sequence
  synthetic polypeptide
ITYLNWY

SEQ ID NO: 6031 - protein, 7 aa, Artificial Sequence
  synthetic polypeptide
STYLNWY

SEQ ID NO: 6032 - protein, 7 aa, Artificial Sequence
  synthetic polypeptide
LSYLNWY

SEQ ID NO: 6033 - protein, 7 aa, Artificial Sequence
  synthetic polypeptide
VSYVNWY

SEQ ID NO: 6034 - protein, 7 aa, Artificial Sequence
  synthetic polypeptide
LSYLNWY

SEQ ID NO: 6035 - protein, 7 aa, Artificial Sequence
  synthetic polypeptide
ISYLNWY

SEQ ID NO: 6036 - protein, 7 aa, Artificial Sequence
  synthetic polypeptide
SSYLNWY

SEQ ID NO: 6037 - protein, 7 aa, Artificial Sequence
  synthetic polypeptide
LSYLNWY

SEQ ID NO: 6038 - protein, 7 aa, Artificial Sequence
  synthetic polypeptide
SSYLNWY

SEQ ID NO: 6039 - protein, 7 aa, Artificial Sequence
  synthetic polypeptide
ITYVNWY

SEQ ID NO: 6040 - protein, 7 aa, Artificial Sequence
  synthetic polypeptide
ISYLNWY

SEQ ID NO: 6041 - protein, 7 aa, Artificial Sequence
  synthetic polypeptide
LTYLNWY

SEQ ID NO: 6042 - protein, 7 aa, Artificial Sequence
  synthetic polypeptide
LSYLNWY

SEQ ID NO: 6043 - protein, 7 aa, Artificial Sequence
  synthetic polypeptide
STYVNWY

SEQ ID NO: 6044 - protein, 7 aa, Artificial Sequence
  synthetic polypeptide
LTYVNWY

SEQ ID NO: 6045 - protein, 7 aa, Artificial Sequence
  synthetic polypeptide
VSYVNWY

SEQ ID NO: 6046 - protein, 7 aa, Artificial Sequence
  synthetic polypeptide
LTYLNWY

SEQ ID NO: 6047 - protein, 7 aa, Artificial Sequence
  synthetic polypeptide
VTYLNWY

SEQ ID NO: 6048 - protein, 7 aa, Artificial Sequence
  synthetic polypeptide
VSYVNWY

SEQ ID NO: 6049 - protein, 7 aa, Artificial Sequence
  synthetic polypeptide
LSYLNWY

SEQ ID NO: 6050 - protein, 7 aa, Artificial Sequence
  synthetic polypeptide
ISYLNWY

SEQ ID NO: 6051 - protein, 7 aa, Artificial Sequence
  synthetic polypeptide
SSYVNWY

SEQ ID NO: 6052 - protein, 7 aa, Artificial Sequence
  synthetic polypeptide
LTYLNWY

SEQ ID NO: 6053 - protein, 7 aa, Artificial Sequence
  synthetic polypeptide
VSYLNWY

SEQ ID NO: 6054 - protein, 7 aa, Artificial Sequence
  synthetic polypeptide
LTYLNWY

SEQ ID NO: 6055 - protein, 7 aa, Artificial Sequence
  synthetic polypeptide
ISYLNWY

SEQ ID NO: 6056 - protein, 7 aa, Artificial Sequence
  synthetic polypeptide
LSYLNWY

SEQ ID NO: 6057 - protein, 7 aa, Artificial Sequence
  synthetic polypeptide
LTYLNWY

SEQ ID NO: 6058 - protein, 7 aa, Artificial Sequence
  synthetic polypeptide
VTYLNWY

SEQ ID NO: 6059 - protein, 7 aa, Artificial Sequence
  synthetic polypeptide
LSYLNWY

SEQ ID NO: 6060 - protein, 7 aa, Artificial Sequence
  synthetic polypeptide
LSYLNWY

SEQ ID NO: 6061 - protein, 7 aa, Artificial Sequence
  synthetic polypeptide
LSYVNWY

SEQ ID NO: 6062 - protein, 7 aa, Artificial Sequence
  synthetic polypeptide
LSYLNWY

SEQ ID NO: 6063 - protein, 7 aa, Artificial Sequence
  synthetic polypeptide
ITYLNWY

SEQ ID NO: 6064 - protein, 7 aa, Artificial Sequence
  synthetic polypeptide
LSYVNWY

SEQ ID NO: 6065 - protein, 7 aa, Artificial Sequence
  synthetic polypeptide
LTYLNWY

SEQ ID NO: 6066 - protein, 7 aa, Artificial Sequence
  synthetic polypeptide
LSYLNWY

SEQ ID NO: 6067 - protein, 7 aa, Artificial Sequence
  synthetic polypeptide
VSYLNWY

SEQ ID NO: 6068 - protein, 7 aa, Artificial Sequence
  synthetic polypeptide
LSYVNWY

SEQ ID NO: 6069 - protein, 7 aa, Artificial Sequence
  synthetic polypeptide
LSYLNWY

SEQ ID NO: 6070 - protein, 7 aa, Artificial Sequence
  synthetic polypeptide
LSYVNWY

SEQ ID NO: 6071 - protein, 7 aa, Artificial Sequence
  synthetic polypeptide
VTYLNWY

SEQ ID NO: 6072 - protein, 7 aa, Artificial Sequence
  synthetic polypeptide
VSYLNWY

SEQ ID NO: 6073 - protein, 7 aa, Artificial Sequence
  synthetic polypeptide
LSYLNWY

SEQ ID NO: 6074 - protein, 7 aa, Artificial Sequence
  synthetic polypeptide
LSYLNWY

SEQ ID NO: 6075 - protein, 7 aa, Artificial Sequence
  synthetic polypeptide
VSYVNWY

SEQ ID NO: 6076 - protein, 7 aa, Artificial Sequence
  synthetic polypeptide
VTYLNWY

SEQ ID NO: 6077 - protein, 7 aa, Artificial Sequence
  synthetic polypeptide
VSYVNWY

SEQ ID NO: 6078 - protein, 7 aa, Artificial Sequence
  synthetic polypeptide
STYLNWY

SEQ ID NO: 6079 - protein, 7 aa, Artificial Sequence
  synthetic polypeptide
ISYLNWY

SEQ ID NO: 6080 - protein, 7 aa, Artificial Sequence
  synthetic polypeptide
STYLNWY

SEQ ID NO: 6081 - protein, 7 aa, Artificial Sequence
  synthetic polypeptide
SSYLNWY

SEQ ID NO: 6082 - protein, 7 aa, Artificial Sequence
  synthetic polypeptide
ISYVNWY

SEQ ID NO: 6083 - protein, 7 aa, Artificial Sequence
  synthetic polypeptide
LSYLNWY

SEQ ID NO: 6084 - protein, 7 aa, Artificial Sequence
  synthetic polypeptide
LSYLNWY

SEQ ID NO: 6085 - protein, 7 aa, Artificial Sequence
  synthetic polypeptide
LSYLNWY

SEQ ID NO: 6086 - protein, 7 aa, Artificial Sequence
  synthetic polypeptide
LSYVNWY

SEQ ID NO: 6087 - protein, 7 aa, Artificial Sequence
  synthetic polypeptide
LTYLNWY

SEQ ID NO: 6088 - protein, 7 aa, Artificial Sequence
  synthetic polypeptide
ISYLNWY

SEQ ID NO: 6089 - protein, 7 aa, Artificial Sequence
  synthetic polypeptide
SSYLNWY

SEQ ID NO: 6090 - protein, 7 aa, Artificial Sequence
  synthetic polypeptide
ISYVNWY

SEQ ID NO: 6091 - protein, 7 aa, Artificial Sequence
  synthetic polypeptide
STYLNWY

SEQ ID NO: 6092 - protein, 7 aa, Artificial Sequence
  synthetic polypeptide
LSYVNWY

SEQ ID NO: 6093 - protein, 7 aa, Artificial Sequence
  synthetic polypeptide
VSYVNWY

SEQ ID NO: 6094 - protein, 7 aa, Artificial Sequence
  synthetic polypeptide
LSYVNWY

SEQ ID NO: 6095 - protein, 7 aa, Artificial Sequence
  synthetic polypeptide
VSYLNWY

SEQ ID NO: 6096 - protein, 7 aa, Artificial Sequence
  synthetic polypeptide
LTYLNWY

SEQ ID NO: 6097 - protein, 7 aa, Artificial Sequence
  synthetic polypeptide
VTYLNWY

SEQ ID NO: 6098 - protein, 7 aa, Artificial Sequence
  synthetic polypeptide
LSYLNWY

SEQ ID NO: 6099 - protein, 7 aa, Artificial Sequence
  synthetic polypeptide
LSYVNWY

SEQ ID NO: 6100 - protein, 7 aa, Artificial Sequence
  synthetic polypeptide
LTYLNWY

SEQ ID NO: 6101 - protein, 7 aa, Artificial Sequence
  synthetic polypeptide
LTYLNWY

SEQ ID NO: 6102 - protein, 7 aa, Artificial Sequence
  synthetic polypeptide
LTYLNWY

SEQ ID NO: 6103 - protein, 7 aa, Artificial Sequence
  synthetic polypeptide
VTYLNWY

SEQ ID NO: 6104 - protein, 7 aa, Artificial Sequence
  synthetic polypeptide
LTYVNWY

SEQ ID NO: 6105 - protein, 7 aa, Artificial Sequence
  synthetic polypeptide
VTYLNWY

SEQ ID NO: 6106 - protein, 7 aa, Artificial Sequence
  synthetic polypeptide
LTYLNWY

SEQ ID NO: 6107 - protein, 7 aa, Artificial Sequence
  synthetic polypeptide
LTYVNWY

SEQ ID NO: 6108 - protein, 7 aa, Artificial Sequence
  synthetic polypeptide
VSYLNWY

SEQ ID NO: 6109 - protein, 7 aa, Artificial Sequence
  synthetic polypeptide
LSYVNWY

SEQ ID NO: 6110 - protein, 7 aa, Artificial Sequence
  synthetic polypeptide
LTYVNWY

SEQ ID NO: 6111 - protein, 7 aa, Artificial Sequence
  synthetic polypeptide
LTYLNWY

SEQ ID NO: 6112 - protein, 7 aa, Artificial Sequence
  synthetic polypeptide
VSYVNWY

SEQ ID NO: 6113 - protein, 7 aa, Artificial Sequence
  synthetic polypeptide
STYLNWY

SEQ ID NO: 6114 - protein, 7 aa, Artificial Sequence
  synthetic polypeptide
LTYLNWY

SEQ ID NO: 6115 - protein, 7 aa, Artificial Sequence
  synthetic polypeptide
LSYLNWY

SEQ ID NO: 6116 - protein, 7 aa, Artificial Sequence
  synthetic polypeptide
VTYLNWY

SEQ ID NO: 6117 - protein, 7 aa, Artificial Sequence
  synthetic polypeptide
ITYLNWY

SEQ ID NO: 6118 - protein, 7 aa, Artificial Sequence
  synthetic polypeptide
LSYLNWY

SEQ ID NO: 6119 - protein, 7 aa, Artificial Sequence
  synthetic polypeptide
LTYVNWY

SEQ ID NO: 6120 - protein, 7 aa, Artificial Sequence
  synthetic polypeptide
LTYLNWY

SEQ ID NO: 6121 - protein, 7 aa, Artificial Sequence
  synthetic polypeptide
VSYLNWY

SEQ ID NO: 6122 - protein, 7 aa, Artificial Sequence
  synthetic polypeptide
VSYVNWY

SEQ ID NO: 6123 - protein, 7 aa, Artificial Sequence
  synthetic polypeptide
LTYVNWY

SEQ ID NO: 6124 - protein, 7 aa, Artificial Sequence
  synthetic polypeptide
LTYLNWY

SEQ ID NO: 6125 - protein, 7 aa, Artificial Sequence
  synthetic polypeptide
VSYLNWY

SEQ ID NO: 6126 - protein, 7 aa, Artificial Sequence
  synthetic polypeptide
LTYLNWY

SEQ ID NO: 6127 - protein, 7 aa, Artificial Sequence
  synthetic polypeptide
VTYLNWY

SEQ ID NO: 6128 - protein, 7 aa, Artificial Sequence
  synthetic polypeptide
LTYLNWY

SEQ ID NO: 6129 - protein, 7 aa, Artificial Sequence
  synthetic polypeptide
LSYVNWY

SEQ ID NO: 6130 - protein, 7 aa, Artificial Sequence
  synthetic polypeptide
VSYLNWY

SEQ ID NO: 6131 - protein, 7 aa, Artificial Sequence
  synthetic polypeptide
LTYVNWY

SEQ ID NO: 6132 - protein, 7 aa, Artificial Sequence
  synthetic polypeptide
LSYLNWY

SEQ ID NO: 6133 - protein, 7 aa, Artificial Sequence
  synthetic polypeptide
LSYLNWY

SEQ ID NO: 6134 - protein, 7 aa, Artificial Sequence
  synthetic polypeptide
ISYVNWY

SEQ ID NO: 6135 - protein, 7 aa, Artificial Sequence
  synthetic polypeptide
LSYLNWY

SEQ ID NO: 6136 - protein, 7 aa, Artificial Sequence
  synthetic polypeptide
LTYVNWY

SEQ ID NO: 6137 - protein, 7 aa, Artificial Sequence
  synthetic polypeptide
SSYLNWY

SEQ ID NO: 6138 - protein, 7 aa, Artificial Sequence
  synthetic polypeptide
LTYVNWY

SEQ ID NO: 6139 - protein, 7 aa, Artificial Sequence
  synthetic polypeptide
VRYLNWY

SEQ ID NO: 6140 - protein, 7 aa, Artificial Sequence
  synthetic polypeptide
VSYLNWY

SEQ ID NO: 6141 - protein, 7 aa, Artificial Sequence
  synthetic polypeptide
ISYVNWY

SEQ ID NO: 6142 - protein, 7 aa, Artificial Sequence
  synthetic polypeptide
LSYLNWY

SEQ ID NO: 6143 - protein, 7 aa, Artificial Sequence
  synthetic polypeptide
ISYVNWY

SEQ ID NO: 6144 - protein, 7 aa, Artificial Sequence
  synthetic polypeptide
LSYLNWY

SEQ ID NO: 6145 - protein, 7 aa, Artificial Sequence
  synthetic polypeptide
LTYLNWY

SEQ ID NO: 6146 - protein, 7 aa, Artificial Sequence
  synthetic polypeptide
VTYLNWY

SEQ ID NO: 6147 - protein, 7 aa, Artificial Sequence
  synthetic polypeptide
LSYLNWY

SEQ ID NO: 6148 - protein, 7 aa, Artificial Sequence
  synthetic polypeptide
VTYLNWY

SEQ ID NO: 6149 - protein, 7 aa, Artificial Sequence
  synthetic polypeptide
LTYLNWY

SEQ ID NO: 6150 - protein, 7 aa, Artificial Sequence
  synthetic polypeptide
LTYLNWY

SEQ ID NO: 6151 - protein, 7 aa, Artificial Sequence
  synthetic polypeptide
LTYVNWY

SEQ ID NO: 6152 - protein, 7 aa, Artificial Sequence
  synthetic polypeptide
LTYLNWY

SEQ ID NO: 6153 - protein, 7 aa, Artificial Sequence
  synthetic polypeptide
LTYLNWY

SEQ ID NO: 6154 - protein, 7 aa, Artificial Sequence
  synthetic polypeptide
LSYLNWY

SEQ ID NO: 6155 - protein, 7 aa, Artificial Sequence
  synthetic polypeptide
LSYLNWY

SEQ ID NO: 6156 - protein, 7 aa, Artificial Sequence
  synthetic polypeptide
LSYLNWY

SEQ ID NO: 6157 - protein, 7 aa, Artificial Sequence
  synthetic polypeptide
LSYLNWY

SEQ ID NO: 6158 - protein, 7 aa, Artificial Sequence
  synthetic polypeptide
LSYLNWY

SEQ ID NO: 6159 - protein, 7 aa, Artificial Sequence
  synthetic polypeptide
LSYLNWY

SEQ ID NO: 6160 - protein, 7 aa, Artificial Sequence
  synthetic polypeptide
VSYVNWY

SEQ ID NO: 6161 - protein, 7 aa, Artificial Sequence
  synthetic polypeptide
VSYLNWY

SEQ ID NO: 6162 - protein, 7 aa, Artificial Sequence
  synthetic polypeptide
LSYVNWY

SEQ ID NO: 6163 - protein, 7 aa, Artificial Sequence
  synthetic polypeptide
LSYLNWY

SEQ ID NO: 6164 - protein, 7 aa, Artificial Sequence
  synthetic polypeptide
LTYLNWY

SEQ ID NO: 6165 - protein, 7 aa, Artificial Sequence
  synthetic polypeptide
LSYVNWY

SEQ ID NO: 6166 - protein, 7 aa, Artificial Sequence
  synthetic polypeptide
LSYLNWY

SEQ ID NO: 6167 - protein, 7 aa, Artificial Sequence
  synthetic polypeptide
LSYVNWY

SEQ ID NO: 6168 - protein, 7 aa, Artificial Sequence
  synthetic polypeptide
LSYLNWY

SEQ ID NO: 6169 - protein, 7 aa, Artificial Sequence
  synthetic polypeptide
SSYLNWY

SEQ ID NO: 6170 - protein, 7 aa, Artificial Sequence
  synthetic polypeptide
LSYVNWY

SEQ ID NO: 6171 - protein, 7 aa, Artificial Sequence
  synthetic polypeptide
LTYVNWY

SEQ ID NO: 6172 - protein, 7 aa, Artificial Sequence
  synthetic polypeptide
SSYLNWY

SEQ ID NO: 6173 - protein, 7 aa, Artificial Sequence
  synthetic polypeptide
LTYVNWY

SEQ ID NO: 6174 - protein, 7 aa, Artificial Sequence
  synthetic polypeptide
ISYVNWY

SEQ ID NO: 6175 - protein, 7 aa, Artificial Sequence
  synthetic polypeptide
VSYVNWY

SEQ ID NO: 6176 - protein, 7 aa, Artificial Sequence
  synthetic polypeptide
LSYVNWY

SEQ ID NO: 6177 - protein, 7 aa, Artificial Sequence
  synthetic polypeptide
LTYLNWY

SEQ ID NO: 6178 - protein, 7 aa, Artificial Sequence
  synthetic polypeptide
LTYVNWY

SEQ ID NO: 6179 - protein, 7 aa, Artificial Sequence
  synthetic polypeptide
SRYLNWY

SEQ ID NO: 6180 - protein, 10 aa, Artificial Sequence
  synthetic polypeptide
LLIYAATSRH

SEQ ID NO: 6181 - protein, 10 aa, Artificial Sequence
  synthetic polypeptide
LLIYAASSLQ

SEQ ID NO: 6182 - protein, 10 aa, Artificial Sequence
  synthetic polypeptide
LLIYAATSRA

SEQ ID NO: 6183 - protein, 10 aa, Artificial Sequence
  synthetic polypeptide
LLIYAATSRH

SEQ ID NO: 6184 - protein, 10 aa, Artificial Sequence
  synthetic polypeptide
LLIYAATSRA

SEQ ID NO: 6185 - protein, 10 aa, Artificial Sequence
  synthetic polypeptide
LLIYAATSRA

SEQ ID NO: 6186 - protein, 10 aa, Artificial Sequence
  synthetic polypeptide
LVIYAATSLA

SEQ ID NO: 6187 - protein, 10 aa, Artificial Sequence
  synthetic polypeptide
LVIYAATSLA

SEQ ID NO: 6188 - protein, 10 aa, Artificial Sequence
  synthetic polypeptide
LVIYAATSRA

SEQ ID NO: 6189 - protein, 10 aa, Artificial Sequence
  synthetic polypeptide
LLIYAATSRH

SEQ ID NO: 6190 - protein, 10 aa, Artificial Sequence
  synthetic polypeptide
LLIYAASSLQ

SEQ ID NO: 6191 - protein, 10 aa, Artificial Sequence
  synthetic polypeptide
LVIYAATSRA

SEQ ID NO: 6192 - protein, 10 aa, Artificial Sequence
  synthetic polypeptide
LVIYAVTSRA

SEQ ID NO: 6193 - protein, 10 aa, Artificial Sequence
  synthetic polypeptide
LVIYATTSRA

SEQ ID NO: 6194 - protein, 10 aa, Artificial Sequence
  synthetic polypeptide
LLIYAATSRA

SEQ ID NO: 6195 - protein, 10 aa, Artificial Sequence
  synthetic polypeptide
LLIYAATSRH

SEQ ID NO: 6196 - protein, 10 aa, Artificial Sequence
  synthetic polypeptide
LVIYAATSRH

SEQ ID NO: 6197 - protein, 10 aa, Artificial Sequence
  synthetic polypeptide
LLIYAATSRH

SEQ ID NO: 6198 - protein, 10 aa, Artificial Sequence
  synthetic polypeptide
LLIYAATSRA

SEQ ID NO: 6199 - protein, 10 aa, Artificial Sequence
  synthetic polypeptide
LLIYATTSRH

SEQ ID NO: 6200 - protein, 10 aa, Artificial Sequence
  synthetic polypeptide
LLIYAATSRH

SEQ ID NO: 6201 - protein, 10 aa, Artificial Sequence
  synthetic polypeptide
LLIYAVTSRA

SEQ ID NO: 6202 - protein, 10 aa, Artificial Sequence
  synthetic polypeptide
LLIYAATSLA

SEQ ID NO: 6203 - protein, 10 aa, Artificial Sequence
  synthetic polypeptide
LLIYAATSLH

SEQ ID NO: 6204 - protein, 10 aa, Artificial Sequence
  synthetic polypeptide
LVIYAATSRA

SEQ ID NO: 6205 - protein, 10 aa, Artificial Sequence
  synthetic polypeptide
LLIYAATSRA

SEQ ID NO: 6206 - protein, 10 aa, Artificial Sequence
  synthetic polypeptide
LVIYAATSLA

SEQ ID NO: 6207 - protein, 10 aa, Artificial Sequence
  synthetic polypeptide
LLIYAATSRA

SEQ ID NO: 6208 - protein, 10 aa, Artificial Sequence
  synthetic polypeptide
LLIYAVTSRA

SEQ ID NO: 6209 - protein, 10 aa, Artificial Sequence
  synthetic polypeptide
LLIYAATSRA

SEQ ID NO: 6210 - protein, 10 aa, Artificial Sequence
  synthetic polypeptide
LVIYAATSLA

SEQ ID NO: 6211 - protein, 10 aa, Artificial Sequence
  synthetic polypeptide
LVIYAATSRH

SEQ ID NO: 6212 - protein, 10 aa, Artificial Sequence
  synthetic polypeptide
LVIYAATSRA

SEQ ID NO: 6213 - protein, 10 aa, Artificial Sequence
  synthetic polypeptide
LLIYAATSRH

SEQ ID NO: 6214 - protein, 10 aa, Artificial Sequence
  synthetic polypeptide
LLIYAASSLQ

SEQ ID NO: 6215 - protein, 10 aa, Artificial Sequence
  synthetic polypeptide
LVIYAATSRA

SEQ ID NO: 6216 - protein, 10 aa, Artificial Sequence
  synthetic polypeptide
LVIYAATSRA

SEQ ID NO: 6217 - protein, 10 aa, Artificial Sequence
  synthetic polypeptide
LLIYAASSLQ

SEQ ID NO: 6218 - protein, 10 aa, Artificial Sequence
  synthetic polypeptide
LLIYAATSLA

SEQ ID NO: 6219 - protein, 10 aa, Artificial Sequence
  synthetic polypeptide
LLIYAVTSRA

SEQ ID NO: 6220 - protein, 10 aa, Artificial Sequence
  synthetic polypeptide
LVIYAVTSRA

SEQ ID NO: 6221 - protein, 10 aa, Artificial Sequence
  synthetic polypeptide
LLIYAATSRH

SEQ ID NO: 6222 - protein, 10 aa, Artificial Sequence
  synthetic polypeptide
LLIYAATSLA

SEQ ID NO: 6223 - protein, 10 aa, Artificial Sequence
  synthetic polypeptide
LLIYAASSLQ

SEQ ID NO: 6224 - protein, 10 aa, Artificial Sequence
  synthetic polypeptide
LVIYAVTSRA

SEQ ID NO: 6225 - protein, 10 aa, Artificial Sequence
  synthetic polypeptide
LLIYAASSLQ

SEQ ID NO: 6226 - protein, 10 aa, Artificial Sequence
  synthetic polypeptide
LVIYAATSRA

SEQ ID NO: 6227 - protein, 10 aa, Artificial Sequence
  synthetic polypeptide
LVIYATTSRA

SEQ ID NO: 6228 - protein, 10 aa, Artificial Sequence
  synthetic polypeptide
LVIYAATSRA

SEQ ID NO: 6229 - protein, 10 aa, Artificial Sequence
  synthetic polypeptide
LLIYAATSLA

SEQ ID NO: 6230 - protein, 10 aa, Artificial Sequence
  synthetic polypeptide
LVIYATTSRH

SEQ ID NO: 6231 - protein, 10 aa, Artificial Sequence
  synthetic polypeptide
LVIYAATSRA

SEQ ID NO: 6232 - protein, 10 aa, Artificial Sequence
  synthetic polypeptide
LVIYAATSRA

SEQ ID NO: 6233 - protein, 10 aa, Artificial Sequence
  synthetic polypeptide
LLIYAATSRA

SEQ ID NO: 6234 - protein, 10 aa, Artificial Sequence
  synthetic polypeptide
LVIYAATSRH

SEQ ID NO: 6235 - protein, 10 aa, Artificial Sequence
  synthetic polypeptide
LLIYAASSLQ

SEQ ID NO: 6236 - protein, 10 aa, Artificial Sequence
  synthetic polypeptide
LLIYAASSLQ

SEQ ID NO: 6237 - protein, 10 aa, Artificial Sequence
  synthetic polypeptide
LVIYAATSRA

SEQ ID NO: 6238 - protein, 10 aa, Artificial Sequence
  synthetic polypeptide
LVIYAATSRA

SEQ ID NO: 6239 - protein, 10 aa, Artificial Sequence
  synthetic polypeptide
LVIYAATSRH

SEQ ID NO: 6240 - protein, 10 aa, Artificial Sequence
  synthetic polypeptide
LVIYATTSRA

SEQ ID NO: 6241 - protein, 10 aa, Artificial Sequence
  synthetic polypeptide
LLIYAATSRH

SEQ ID NO: 6242 - protein, 10 aa, Artificial Sequence
  synthetic polypeptide
LVIYAATSRH

SEQ ID NO: 6243 - protein, 10 aa, Artificial Sequence
  synthetic polypeptide
LLIYAATSRA

SEQ ID NO: 6244 - protein, 10 aa, Artificial Sequence
  synthetic polypeptide
LLIYAATSRA

SEQ ID NO: 6245 - protein, 10 aa, Artificial Sequence
  synthetic polypeptide
LLIYAATSLA

SEQ ID NO: 6246 - protein, 10 aa, Artificial Sequence
  synthetic polypeptide
LVIYAATSRA

SEQ ID NO: 6247 - protein, 10 aa, Artificial Sequence
  synthetic polypeptide
LLIYATTSRA

SEQ ID NO: 6248 - protein, 10 aa, Artificial Sequence
  synthetic polypeptide
LVIYAVTSRH

SEQ ID NO: 6249 - protein, 10 aa, Artificial Sequence
  synthetic polypeptide
LVIYATTSLA

SEQ ID NO: 6250 - protein, 10 aa, Artificial Sequence
  synthetic polypeptide
LVIYAATSRH

SEQ ID NO: 6251 - protein, 10 aa, Artificial Sequence
  synthetic polypeptide
LLIYAATSRH

SEQ ID NO: 6252 - protein, 10 aa, Artificial Sequence
  synthetic polypeptide
LLIYAATSRA

SEQ ID NO: 6253 - protein, 10 aa, Artificial Sequence
  synthetic polypeptide
LLIYAATSRA

SEQ ID NO: 6254 - protein, 10 aa, Artificial Sequence
  synthetic polypeptide
LLIYAATSRA

SEQ ID NO: 6255 - protein, 10 aa, Artificial Sequence
  synthetic polypeptide
LLIYAATSRA

SEQ ID NO: 6256 - protein, 10 aa, Artificial Sequence
  synthetic polypeptide
LLIYAATSLA

SEQ ID NO: 6257 - protein, 10 aa, Artificial Sequence
  synthetic polypeptide
LLIYAVTSLH

SEQ ID NO: 6258 - protein, 10 aa, Artificial Sequence
  synthetic polypeptide
LLIYAATSLA

SEQ ID NO: 6259 - protein, 10 aa, Artificial Sequence
  synthetic polypeptide
LLIYAVTSRA

SEQ ID NO: 6260 - protein, 10 aa, Artificial Sequence
  synthetic polypeptide
LVIYAVTSRA

SEQ ID NO: 6261 - protein, 10 aa, Artificial Sequence
  synthetic polypeptide
LLIYAVTSRA

SEQ ID NO: 6262 - protein, 10 aa, Artificial Sequence
  synthetic polypeptide
LLIYAATSRA

SEQ ID NO: 6263 - protein, 10 aa, Artificial Sequence
  synthetic polypeptide
LLIYAATSLH

SEQ ID NO: 6264 - protein, 10 aa, Artificial Sequence
  synthetic polypeptide
LVIYAATSRA

SEQ ID NO: 6265 - protein, 10 aa, Artificial Sequence
  synthetic polypeptide
LLIYAATSLA

SEQ ID NO: 6266 - protein, 10 aa, Artificial Sequence
  synthetic polypeptide
LLIYAATSRA

SEQ ID NO: 6267 - protein, 10 aa, Artificial Sequence
  synthetic polypeptide
LLIYAATSLA

SEQ ID NO: 6268 - protein, 10 aa, Artificial Sequence
  synthetic polypeptide
LVIYAVTSRA

SEQ ID NO: 6269 - protein, 10 aa, Artificial Sequence
  synthetic polypeptide
LVIYAVTSRA

SEQ ID NO: 6270 - protein, 10 aa, Artificial Sequence
  synthetic polypeptide
LLIYAATSRH

SEQ ID NO: 6271 - protein, 10 aa, Artificial Sequence
  synthetic polypeptide
LLIYAVTSLA

SEQ ID NO: 6272 - protein, 10 aa, Artificial Sequence
  synthetic polypeptide
LLIYAATSRA

SEQ ID NO: 6273 - protein, 10 aa, Artificial Sequence
  synthetic polypeptide
LVIYAVTSRH

SEQ ID NO: 6274 - protein, 10 aa, Artificial Sequence
  synthetic polypeptide
LVIYAATSRH

SEQ ID NO: 6275 - protein, 10 aa, Artificial Sequence
  synthetic polypeptide
LVIYAATSRH

SEQ ID NO: 6276 - protein, 10 aa, Artificial Sequence
  synthetic polypeptide
LVIYATTSRA

SEQ ID NO: 6277 - protein, 10 aa, Artificial Sequence
  synthetic polypeptide
LVIYAATSRA

SEQ ID NO: 6278 - protein, 10 aa, Artificial Sequence
  synthetic polypeptide
LVIYAATSRH

SEQ ID NO: 6279 - protein, 10 aa, Artificial Sequence
  synthetic polypeptide
LLIYAATSLA

SEQ ID NO: 6280 - protein, 10 aa, Artificial Sequence
  synthetic polypeptide
LLIYAATSRA

SEQ ID NO: 6281 - protein, 10 aa, Artificial Sequence
  synthetic polypeptide
LVIYAATSRA

SEQ ID NO: 6282 - protein, 10 aa, Artificial Sequence
  synthetic polypeptide
LVIYAATSRA

SEQ ID NO: 6283 - protein, 10 aa, Artificial Sequence
  synthetic polypeptide
LVIYAATSRA

SEQ ID NO: 6284 - protein, 10 aa, Artificial Sequence
  synthetic polypeptide
LVIYAATSRA

SEQ ID NO: 6285 - protein, 10 aa, Artificial Sequence
  synthetic polypeptide
LVIYAATSRA

SEQ ID NO: 6286 - protein, 10 aa, Artificial Sequence
  synthetic polypeptide
LLIYAATSRA

SEQ ID NO: 6287 - protein, 10 aa, Artificial Sequence
  synthetic polypeptide
LLIYAATSLA

SEQ ID NO: 6288 - protein, 10 aa, Artificial Sequence
  synthetic polypeptide
LLIYAATSRA

SEQ ID NO: 6289 - protein, 10 aa, Artificial Sequence
  synthetic polypeptide
LVIYAATSRH

SEQ ID NO: 6290 - protein, 10 aa, Artificial Sequence
  synthetic polypeptide
LLIYAATSRA

SEQ ID NO: 6291 - protein, 10 aa, Artificial Sequence
  synthetic polypeptide
LLIYAATSRA

SEQ ID NO: 6292 - protein, 10 aa, Artificial Sequence
  synthetic polypeptide
LVIYAATSRA

SEQ ID NO: 6293 - protein, 10 aa, Artificial Sequence
  synthetic polypeptide
LLIYAATSLA

SEQ ID NO: 6294 - protein, 10 aa, Artificial Sequence
  synthetic polypeptide
LLIYATTSRA

SEQ ID NO: 6295 - protein, 10 aa, Artificial Sequence
  synthetic polypeptide
LLIYAASSLQ

SEQ ID NO: 6296 - protein, 10 aa, Artificial Sequence
  synthetic polypeptide
LVIYAATSRA

SEQ ID NO: 6297 - protein, 10 aa, Artificial Sequence
  synthetic polypeptide
LVIYAATSRA

SEQ ID NO: 6298 - protein, 10 aa, Artificial Sequence
  synthetic polypeptide
LLIYAATSLA

SEQ ID NO: 6299 - protein, 10 aa, Artificial Sequence
  synthetic polypeptide
LVIYAATSRA

SEQ ID NO: 6300 - protein, 10 aa, Artificial Sequence
  synthetic polypeptide
LLIYAATSRH

SEQ ID NO: 6301 - protein, 10 aa, Artificial Sequence
  synthetic polypeptide
LLIYAATSRH

SEQ ID NO: 6302 - protein, 10 aa, Artificial Sequence
  synthetic polypeptide
LVIYAATSLA

SEQ ID NO: 6303 - protein, 10 aa, Artificial Sequence
  synthetic polypeptide
LLIYAATSRA

SEQ ID NO: 6304 - protein, 10 aa, Artificial Sequence
  synthetic polypeptide
LVIYAATSRA

SEQ ID NO: 6305 - protein, 10 aa, Artificial Sequence
  synthetic polypeptide
LVIYAATSRA

SEQ ID NO: 6306 - protein, 10 aa, Artificial Sequence
  synthetic polypeptide
LLIYAATSRA

SEQ ID NO: 6307 - protein, 10 aa, Artificial Sequence
  synthetic polypeptide
LLIYAATSRA

SEQ ID NO: 6308 - protein, 10 aa, Artificial Sequence
  synthetic polypeptide
LVIYAATSRA

SEQ ID NO: 6309 - protein, 10 aa, Artificial Sequence
  synthetic polypeptide
LVIYAATSLA

SEQ ID NO: 6310 - protein, 10 aa, Artificial Sequence
  synthetic polypeptide
LLIYAATSRA

SEQ ID NO: 6311 - protein, 10 aa, Artificial Sequence
  synthetic polypeptide
LLIYAATSRH

SEQ ID NO: 6312 - protein, 10 aa, Artificial Sequence
  synthetic polypeptide
LVIYAATSRA

SEQ ID NO: 6313 - protein, 10 aa, Artificial Sequence
  synthetic polypeptide
LVIYAATSLH

SEQ ID NO: 6314 - protein, 10 aa, Artificial Sequence
  synthetic polypeptide
LVIYAVTSLA

SEQ ID NO: 6315 - protein, 10 aa, Artificial Sequence
  synthetic polypeptide
LVIYAVTSRA

SEQ ID NO: 6316 - protein, 10 aa, Artificial Sequence
  synthetic polypeptide
LVIYAATSRA

SEQ ID NO: 6317 - protein, 10 aa, Artificial Sequence
  synthetic polypeptide
LVIYAATSRA

SEQ ID NO: 6318 - protein, 10 aa, Artificial Sequence
  synthetic polypeptide
LVIYAATSLA

SEQ ID NO: 6319 - protein, 10 aa, Artificial Sequence
  synthetic polypeptide
LVIYAVTSRA

SEQ ID NO: 6320 - protein, 10 aa, Artificial Sequence
  synthetic polypeptide
LVIYAATSLA

SEQ ID NO: 6321 - protein, 10 aa, Artificial Sequence
  synthetic polypeptide
LVIYAATSLA

SEQ ID NO: 6322 - protein, 10 aa, Artificial Sequence
  synthetic polypeptide
LVIYAATSLH

SEQ ID NO: 6323 - protein, 10 aa, Artificial Sequence
  synthetic polypeptide
LVIYAATSRA

SEQ ID NO: 6324 - protein, 10 aa, Artificial Sequence
  synthetic polypeptide
LLIYAATSRA

SEQ ID NO: 6325 - protein, 10 aa, Artificial Sequence
  synthetic polypeptide
LLIYAATSRA

SEQ ID NO: 6326 - protein, 10 aa, Artificial Sequence
  synthetic polypeptide
LVIYAVTSRA

SEQ ID NO: 6327 - protein, 10 aa, Artificial Sequence
  synthetic polypeptide
LLIYAATSRA

SEQ ID NO: 6328 - protein, 10 aa, Artificial Sequence
  synthetic polypeptide
LVIYAATSRA

SEQ ID NO: 6329 - protein, 10 aa, Artificial Sequence
  synthetic polypeptide
LVIYAATSRA

SEQ ID NO: 6330 - protein, 10 aa, Artificial Sequence
  synthetic polypeptide
LLIYAATSRA

SEQ ID NO: 6331 - protein, 10 aa, Artificial Sequence
  synthetic polypeptide
LLIYAATSRA

SEQ ID NO: 6332 - protein, 10 aa, Artificial Sequence
  synthetic polypeptide
LVIYAATSLA

SEQ ID NO: 6333 - protein, 10 aa, Artificial Sequence
  synthetic polypeptide
LVIYAATSLA

SEQ ID NO: 6334 - protein, 10 aa, Artificial Sequence
  synthetic polypeptide
LVIYAATSRA

SEQ ID NO: 6335 - protein, 10 aa, Artificial Sequence
  synthetic polypeptide
LVIYAATSRA

SEQ ID NO: 6336 - protein, 10 aa, Artificial Sequence
  synthetic polypeptide
LLIYAATSRA

SEQ ID NO: 6337 - protein, 10 aa, Artificial Sequence
  synthetic polypeptide
LLIYAATSRA

SEQ ID NO: 6338 - protein, 10 aa, Artificial Sequence
  synthetic polypeptide
LLIYAATSRH

SEQ ID NO: 6339 - protein, 10 aa, Artificial Sequence
  synthetic polypeptide
LLIYAATSLA

SEQ ID NO: 6340 - protein, 10 aa, Artificial Sequence
  synthetic polypeptide
LLIYAVTSRA

SEQ ID NO: 6341 - protein, 10 aa, Artificial Sequence
  synthetic polypeptide
LLIYAATSRA

SEQ ID NO: 6342 - protein, 10 aa, Artificial Sequence
  synthetic polypeptide
LLIYAATSLA

SEQ ID NO: 6343 - protein, 10 aa, Artificial Sequence
  synthetic polypeptide
LLIYAATSRA

SEQ ID NO: 6344 - protein, 10 aa, Artificial Sequence
  synthetic polypeptide
LVIYAVTSRH

SEQ ID NO: 6345 - protein, 10 aa, Artificial Sequence
  synthetic polypeptide
LVIYAATSLA

SEQ ID NO: 6346 - protein, 10 aa, Artificial Sequence
  synthetic polypeptide
LLIYAVTSRH

SEQ ID NO: 6347 - protein, 10 aa, Artificial Sequence
  synthetic polypeptide
LLIYAASSLQ

SEQ ID NO: 6348 - protein, 10 aa, Artificial Sequence
  synthetic polypeptide
LLIYAASSLQ

SEQ ID NO: 6349 - protein, 10 aa, Artificial Sequence
  synthetic polypeptide
LVIYAATSRH

SEQ ID NO: 6350 - protein, 10 aa, Artificial Sequence
  synthetic polypeptide
LVIYAATSRA

SEQ ID NO: 6351 - protein, 10 aa, Artificial Sequence
  synthetic polypeptide
LLIYAASSLQ

SEQ ID NO: 6352 - protein, 10 aa, Artificial Sequence
  synthetic polypeptide
LVIYAATSRA

SEQ ID NO: 6353 - protein, 10 aa, Artificial Sequence
  synthetic polypeptide
LVIYAATSRA

SEQ ID NO: 6354 - protein, 10 aa, Artificial Sequence
  synthetic polypeptide
LVIYAATSRA

SEQ ID NO: 6355 - protein, 10 aa, Artificial Sequence
  synthetic polypeptide
LLIYAATSRA

SEQ ID NO: 6356 - protein, 10 aa, Artificial Sequence
  synthetic polypeptide
LLIYAATSRA

SEQ ID NO: 6357 - protein, 10 aa, Artificial Sequence
  synthetic polypeptide
LVIYAATSRA

SEQ ID NO: 6358 - protein, 10 aa, Artificial Sequence
  synthetic polypeptide
LLIYAVTSLA

SEQ ID NO: 6359 - protein, 8 aa, Artificial Sequence
  synthetic polypeptide
QQSYNSPL

SEQ ID NO: 6360 - protein, 8 aa, Artificial Sequence
  synthetic polypeptide
QQSYSTPL

SEQ ID NO: 6361 - protein, 8 aa, Artificial Sequence
  synthetic polypeptide
QQSYETPL

SEQ ID NO: 6362 - protein, 8 aa, Artificial Sequence
  synthetic polypeptide
QQSYDTPL

SEQ ID NO: 6363 - protein, 8 aa, Artificial Sequence
  synthetic polypeptide
QQSYDNPL

SEQ ID NO: 6364 - protein, 8 aa, Artificial Sequence
  synthetic polypeptide
QQSYNTPL

SEQ ID NO: 6365 - protein, 8 aa, Artificial Sequence
  synthetic polypeptide
QQSYDTPL

SEQ ID NO: 6366 - protein, 8 aa, Artificial Sequence
  synthetic polypeptide
QQSYENPL

SEQ ID NO: 6367 - protein, 8 aa, Artificial Sequence
  synthetic polypeptide
QQSYNSPL

SEQ ID NO: 6368 - protein, 8 aa, Artificial Sequence
  synthetic polypeptide
QQSYENPL

SEQ ID NO: 6369 - protein, 8 aa, Artificial Sequence
  synthetic polypeptide
QQSYSTPL

SEQ ID NO: 6370 - protein, 8 aa, Artificial Sequence
  synthetic polypeptide
QQSYNSPL

SEQ ID NO: 6371 - protein, 8 aa, Artificial Sequence
  synthetic polypeptide
QQSYELPL

SEQ ID NO: 6372 - protein, 8 aa, Artificial Sequence
  synthetic polypeptide
QQSYNSPL

SEQ ID NO: 6373 - protein, 8 aa, Artificial Sequence
  synthetic polypeptide
QQSYSSPL

SEQ ID NO: 6374 - protein, 8 aa, Artificial Sequence
  synthetic polypeptide
QQSYSNPL

SEQ ID NO: 6375 - protein, 8 aa, Artificial Sequence
  synthetic polypeptide
QQSYDNPL

SEQ ID NO: 6376 - protein, 8 aa, Artificial Sequence
  synthetic polypeptide
QQSYNTPL

SEQ ID NO: 6377 - protein, 8 aa, Artificial Sequence
  synthetic polypeptide
QQSYSSPL

SEQ ID NO: 6378 - protein, 8 aa, Artificial Sequence
  synthetic polypeptide
QQSYDSPL

SEQ ID NO: 6379 - protein, 8 aa, Artificial Sequence
  synthetic polypeptide
QQSYDTPL

SEQ ID NO: 6380 - protein, 8 aa, Artificial Sequence
  synthetic polypeptide
QQSYDSPL

SEQ ID NO: 6381 - protein, 8 aa, Artificial Sequence
  synthetic polypeptide
QQSYDLPL

SEQ ID NO: 6382 - protein, 8 aa, Artificial Sequence
  synthetic polypeptide
QQSYNNPL

SEQ ID NO: 6383 - protein, 8 aa, Artificial Sequence
  synthetic polypeptide
QQSYSTPL

SEQ ID NO: 6384 - protein, 8 aa, Artificial Sequence
  synthetic polypeptide
QQSYELPL

SEQ ID NO: 6385 - protein, 8 aa, Artificial Sequence
  synthetic polypeptide
QQSYDTPL

SEQ ID NO: 6386 - protein, 8 aa, Artificial Sequence
  synthetic polypeptide
QQSYNLPL

SEQ ID NO: 6387 - protein, 8 aa, Artificial Sequence
  synthetic polypeptide
QQSYETPL

SEQ ID NO: 6388 - protein, 8 aa, Artificial Sequence
  synthetic polypeptide
QQSYDTPL

SEQ ID NO: 6389 - protein, 8 aa, Artificial Sequence
  synthetic polypeptide
QQSYNSPL

SEQ ID NO: 6390 - protein, 8 aa, Artificial Sequence
  synthetic polypeptide
QQSDDLPL

SEQ ID NO: 6391 - protein, 8 aa, Artificial Sequence
  synthetic polypeptide
QQSYESPL

SEQ ID NO: 6392 - protein, 8 aa, Artificial Sequence
  synthetic polypeptide
QQSYDSPL

SEQ ID NO: 6393 - protein, 8 aa, Artificial Sequence
  synthetic polypeptide
QQSYSTPL

SEQ ID NO: 6394 - protein, 8 aa, Artificial Sequence
  synthetic polypeptide
QQSYDLPL

SEQ ID NO: 6395 - protein, 8 aa, Artificial Sequence
  synthetic polypeptide
QQSYDSPL

SEQ ID NO: 6396 - protein, 8 aa, Artificial Sequence
  synthetic polypeptide
QQSYSTPL

SEQ ID NO: 6397 - protein, 8 aa, Artificial Sequence
  synthetic polypeptide
QQSYDLPL

SEQ ID NO: 6398 - protein, 8 aa, Artificial Sequence
  synthetic polypeptide
QQSYENPL

SEQ ID NO: 6399 - protein, 8 aa, Artificial Sequence
  synthetic polypeptide
QQSYELPL

SEQ ID NO: 6400 - protein, 8 aa, Artificial Sequence
  synthetic polypeptide
QQSYDTPL

SEQ ID NO: 6401 - protein, 8 aa, Artificial Sequence
  synthetic polypeptide
QQSYSTPL

SEQ ID NO: 6402 - protein, 8 aa, Artificial Sequence
  synthetic polypeptide
QQSYSTPL

SEQ ID NO: 6403 - protein, 8 aa, Artificial Sequence
  synthetic polypeptide
QQSYDSPL

SEQ ID NO: 6404 - protein, 8 aa, Artificial Sequence
  synthetic polypeptide
QQSYETPL

SEQ ID NO: 6405 - protein, 8 aa, Artificial Sequence
  synthetic polypeptide
QQSYESPL

SEQ ID NO: 6406 - protein, 8 aa, Artificial Sequence
  synthetic polypeptide
QQSYESPL

SEQ ID NO: 6407 - protein, 8 aa, Artificial Sequence
  synthetic polypeptide
QQSYESPL

SEQ ID NO: 6408 - protein, 8 aa, Artificial Sequence
  synthetic polypeptide
QQSYDTPL

SEQ ID NO: 6409 - protein, 8 aa, Artificial Sequence
  synthetic polypeptide
QQSYNSPL

SEQ ID NO: 6410 - protein, 8 aa, Artificial Sequence
  synthetic polypeptide
QQSYENPL

SEQ ID NO: 6411 - protein, 8 aa, Artificial Sequence
  synthetic polypeptide
QQSYDLPL

SEQ ID NO: 6412 - protein, 8 aa, Artificial Sequence
  synthetic polypeptide
QQSYDSPL

SEQ ID NO: 6413 - protein, 8 aa, Artificial Sequence
  synthetic polypeptide
QQSYDSPL

SEQ ID NO: 6414 - protein, 8 aa, Artificial Sequence
  synthetic polypeptide
QQSYDLPL

SEQ ID NO: 6415 - protein, 8 aa, Artificial Sequence
  synthetic polypeptide
QQSYSTPL

SEQ ID NO: 6416 - protein, 8 aa, Artificial Sequence
  synthetic polypeptide
QQSYDSPL

SEQ ID NO: 6417 - protein, 8 aa, Artificial Sequence
  synthetic polypeptide
QQSYNNPL

SEQ ID NO: 6418 - protein, 8 aa, Artificial Sequence
  synthetic polypeptide
QQGYDLPL

SEQ ID NO: 6419 - protein, 8 aa, Artificial Sequence
  synthetic polypeptide
QQSYETPL

SEQ ID NO: 6420 - protein, 8 aa, Artificial Sequence
  synthetic polypeptide
QQSYNTPL

SEQ ID NO: 6421 - protein, 8 aa, Artificial Sequence
  synthetic polypeptide
QQSYDTPL

SEQ ID NO: 6422 - protein, 8 aa, Artificial Sequence
  synthetic polypeptide
QQSYENPL

SEQ ID NO: 6423 - protein, 8 aa, Artificial Sequence
  synthetic polypeptide
QQSYESPL

SEQ ID NO: 6424 - protein, 8 aa, Artificial Sequence
  synthetic polypeptide
QQSDSSPL

SEQ ID NO: 6425 - protein, 8 aa, Artificial Sequence
  synthetic polypeptide
QQSYENPL

SEQ ID NO: 6426 - protein, 8 aa, Artificial Sequence
  synthetic polypeptide
QQSYDNPL

SEQ ID NO: 6427 - protein, 8 aa, Artificial Sequence
  synthetic polypeptide
QQSYDSPL

SEQ ID NO: 6428 - protein, 8 aa, Artificial Sequence
  synthetic polypeptide
QQSYDTPL

SEQ ID NO: 6429 - protein, 8 aa, Artificial Sequence
  synthetic polypeptide
QQSYNNPL

SEQ ID NO: 6430 - protein, 8 aa, Artificial Sequence
  synthetic polypeptide
QQSYDNPL

SEQ ID NO: 6431 - protein, 8 aa, Artificial Sequence
  synthetic polypeptide
QQSYSTPL

SEQ ID NO: 6432 - protein, 8 aa, Artificial Sequence
  synthetic polypeptide
QQSYDSPL

SEQ ID NO: 6433 - protein, 8 aa, Artificial Sequence
  synthetic polypeptide
QQSYDTPL

SEQ ID NO: 6434 - protein, 8 aa, Artificial Sequence
  synthetic polypeptide
QQSYDSPL

SEQ ID NO: 6435 - protein, 8 aa, Artificial Sequence
  synthetic polypeptide
QQSYENPL

SEQ ID NO: 6436 - protein, 8 aa, Artificial Sequence
  synthetic polypeptide
QQSYESPL

SEQ ID NO: 6437 - protein, 8 aa, Artificial Sequence
  synthetic polypeptide
QQSYESPL

SEQ ID NO: 6438 - protein, 8 aa, Artificial Sequence
  synthetic polypeptide
QQSYNSPL

SEQ ID NO: 6439 - protein, 8 aa, Artificial Sequence
  synthetic polypeptide
QQSYESPL

SEQ ID NO: 6440 - protein, 8 aa, Artificial Sequence
  synthetic polypeptide
QQSYDLPL

SEQ ID NO: 6441 - protein, 8 aa, Artificial Sequence
  synthetic polypeptide
QQSYDLPL

SEQ ID NO: 6442 - protein, 8 aa, Artificial Sequence
  synthetic polypeptide
QQSYESPL

SEQ ID NO: 6443 - protein, 8 aa, Artificial Sequence
  synthetic polypeptide
QQSDSTPL

SEQ ID NO: 6444 - protein, 8 aa, Artificial Sequence
  synthetic polypeptide
QQSYDSPL

SEQ ID NO: 6445 - protein, 8 aa, Artificial Sequence
  synthetic polypeptide
QQSYNSPL

SEQ ID NO: 6446 - protein, 8 aa, Artificial Sequence
  synthetic polypeptide
QQSYSLPL

SEQ ID NO: 6447 - protein, 8 aa, Artificial Sequence
  synthetic polypeptide
QQSYDLPL

SEQ ID NO: 6448 - protein, 8 aa, Artificial Sequence
  synthetic polypeptide
QQSYDTPL

SEQ ID NO: 6449 - protein, 8 aa, Artificial Sequence
  synthetic polypeptide
QQSYENPL

SEQ ID NO: 6450 - protein, 8 aa, Artificial Sequence
  synthetic polypeptide
QQSYETPL

SEQ ID NO: 6451 - protein, 8 aa, Artificial Sequence
  synthetic polypeptide
QQSYSSPL

SEQ ID NO: 6452 - protein, 8 aa, Artificial Sequence
  synthetic polypeptide
QQSYDSPL

SEQ ID NO: 6453 - protein, 8 aa, Artificial Sequence
  synthetic polypeptide
QQSYDSPL

SEQ ID NO: 6454 - protein, 8 aa, Artificial Sequence
  synthetic polypeptide
QQSYDSPL

SEQ ID NO: 6455 - protein, 8 aa, Artificial Sequence
  synthetic polypeptide
QQSYNLPL

SEQ ID NO: 6456 - protein, 8 aa, Artificial Sequence
  synthetic polypeptide
QQSYDNPL

SEQ ID NO: 6457 - protein, 8 aa, Artificial Sequence
  synthetic polypeptide
QQSYESPL

SEQ ID NO: 6458 - protein, 8 aa, Artificial Sequence
  synthetic polypeptide
QQSYDTPL

SEQ ID NO: 6459 - protein, 8 aa, Artificial Sequence
  synthetic polypeptide
QQSYDLPL

SEQ ID NO: 6460 - protein, 8 aa, Artificial Sequence
  synthetic polypeptide
QQSYDTPL

SEQ ID NO: 6461 - protein, 8 aa, Artificial Sequence
  synthetic polypeptide
QQSYSNPL

SEQ ID NO: 6462 - protein, 8 aa, Artificial Sequence
  synthetic polypeptide
QQSYELPL

SEQ ID NO: 6463 - protein, 8 aa, Artificial Sequence
  synthetic polypeptide
QQSYDSPL

SEQ ID NO: 6464 - protein, 8 aa, Artificial Sequence
  synthetic polypeptide
QQSYETPL

SEQ ID NO: 6465 - protein, 8 aa, Artificial Sequence
  synthetic polypeptide
QQSYDNPL

SEQ ID NO: 6466 - protein, 8 aa, Artificial Sequence
  synthetic polypeptide
QQSYDTPL

SEQ ID NO: 6467 - protein, 8 aa, Artificial Sequence
  synthetic polypeptide
QQSYSLPL

SEQ ID NO: 6468 - protein, 8 aa, Artificial Sequence
  synthetic polypeptide
QQSYETPL

SEQ ID NO: 6469 - protein, 8 aa, Artificial Sequence
  synthetic polypeptide
QQSYDTPL

SEQ ID NO: 6470 - protein, 8 aa, Artificial Sequence
  synthetic polypeptide
QQSYNLPL

SEQ ID NO: 6471 - protein, 8 aa, Artificial Sequence
  synthetic polypeptide
QQSYETPL

SEQ ID NO: 6472 - protein, 8 aa, Artificial Sequence
  synthetic polypeptide
QQSYDSPL

SEQ ID NO: 6473 - protein, 8 aa, Artificial Sequence
  synthetic polypeptide
QQSYENPL

SEQ ID NO: 6474 - protein, 8 aa, Artificial Sequence
  synthetic polypeptide
QQSYDSPL

SEQ ID NO: 6475 - protein, 8 aa, Artificial Sequence
  synthetic polypeptide
QQSDDSPL

SEQ ID NO: 6476 - protein, 8 aa, Artificial Sequence
  synthetic polypeptide
QQSYDSPL

SEQ ID NO: 6477 - protein, 8 aa, Artificial Sequence
  synthetic polypeptide
QQSYDSPL

SEQ ID NO: 6478 - protein, 8 aa, Artificial Sequence
  synthetic polypeptide
QQSYDSPL

SEQ ID NO: 6479 - protein, 8 aa, Artificial Sequence
  synthetic polypeptide
QQSYESPL

SEQ ID NO: 6480 - protein, 8 aa, Artificial Sequence
  synthetic polypeptide
QQSYELPL

SEQ ID NO: 6481 - protein, 8 aa, Artificial Sequence
  synthetic polypeptide
QQSYDTPL

SEQ ID NO: 6482 - protein, 8 aa, Artificial Sequence
  synthetic polypeptide
QQSYETPL

SEQ ID NO: 6483 - protein, 8 aa, Artificial Sequence
  synthetic polypeptide
QQSYELPL

SEQ ID NO: 6484 - protein, 8 aa, Artificial Sequence
  synthetic polypeptide
QQSDNSPL

SEQ ID NO: 6485 - protein, 8 aa, Artificial Sequence
  synthetic polypeptide
QQSYDTPL

SEQ ID NO: 6486 - protein, 8 aa, Artificial Sequence
  synthetic polypeptide
QQSYDTPL

SEQ ID NO: 6487 - protein, 8 aa, Artificial Sequence
  synthetic polypeptide
QQSYDSPL

SEQ ID NO: 6488 - protein, 8 aa, Artificial Sequence
  synthetic polypeptide
QQSYNSPL

SEQ ID NO: 6489 - protein, 8 aa, Artificial Sequence
  synthetic polypeptide
QQSYDNPL

SEQ ID NO: 6490 - protein, 8 aa, Artificial Sequence
  synthetic polypeptide
QQSYDSPL

SEQ ID NO: 6491 - protein, 8 aa, Artificial Sequence
  synthetic polypeptide
QQSYDNPL

SEQ ID NO: 6492 - protein, 8 aa, Artificial Sequence
  synthetic polypeptide
QQSYSTPL

SEQ ID NO: 6493 - protein, 8 aa, Artificial Sequence
  synthetic polypeptide
QQSYESPL

SEQ ID NO: 6494 - protein, 8 aa, Artificial Sequence
  synthetic polypeptide
QQSYDTPL

SEQ ID NO: 6495 - protein, 8 aa, Artificial Sequence
  synthetic polypeptide
QQSDDTPL

SEQ ID NO: 6496 - protein, 8 aa, Artificial Sequence
  synthetic polypeptide
QQSYDSPL

SEQ ID NO: 6497 - protein, 8 aa, Artificial Sequence
  synthetic polypeptide
QQSYELPL

SEQ ID NO: 6498 - protein, 8 aa, Artificial Sequence
  synthetic polypeptide
QQSYDSPL

SEQ ID NO: 6499 - protein, 8 aa, Artificial Sequence
  synthetic polypeptide
QQSYDSPL

SEQ ID NO: 6500 - protein, 8 aa, Artificial Sequence
  synthetic polypeptide
QQSYENPL

SEQ ID NO: 6501 - protein, 8 aa, Artificial Sequence
  synthetic polypeptide
QQSYSNPL

SEQ ID NO: 6502 - protein, 8 aa, Artificial Sequence
  synthetic polypeptide
QQSYNTPL

SEQ ID NO: 6503 - protein, 8 aa, Artificial Sequence
  synthetic polypeptide
QQSYDTPL

SEQ ID NO: 6504 - protein, 8 aa, Artificial Sequence
  synthetic polypeptide
QQSYESPL

SEQ ID NO: 6505 - protein, 8 aa, Artificial Sequence
  synthetic polypeptide
QQSYETPL

SEQ ID NO: 6506 - protein, 8 aa, Artificial Sequence
  synthetic polypeptide
QQSYDTPL

SEQ ID NO: 6507 - protein, 8 aa, Artificial Sequence
  synthetic polypeptide
QQSYESPL

SEQ ID NO: 6508 - protein, 8 aa, Artificial Sequence
  synthetic polypeptide
QQSYETPL

SEQ ID NO: 6509 - protein, 8 aa, Artificial Sequence
  synthetic polypeptide
QQSDDSPL

SEQ ID NO: 6510 - protein, 8 aa, Artificial Sequence
  synthetic polypeptide
QQSYSSPL

SEQ ID NO: 6511 - protein, 8 aa, Artificial Sequence
  synthetic polypeptide
QQSYDNPL

SEQ ID NO: 6512 - protein, 8 aa, Artificial Sequence
  synthetic polypeptide
QQSYSSPL

SEQ ID NO: 6513 - protein, 8 aa, Artificial Sequence
  synthetic polypeptide
QQSYDSPL

SEQ ID NO: 6514 - protein, 8 aa, Artificial Sequence
  synthetic polypeptide
QQSYDNPL

SEQ ID NO: 6515 - protein, 8 aa, Artificial Sequence
  synthetic polypeptide
QQSYDSPL

SEQ ID NO: 6516 - protein, 8 aa, Artificial Sequence
  synthetic polypeptide
QQSYDSPL

SEQ ID NO: 6517 - protein, 8 aa, Artificial Sequence
  synthetic polypeptide
QQSYDNPL

SEQ ID NO: 6518 - protein, 8 aa, Artificial Sequence
  synthetic polypeptide
QQSYDSPL

SEQ ID NO: 6519 - protein, 8 aa, Artificial Sequence
  synthetic polypeptide
QQSYDSPL

SEQ ID NO: 6520 - protein, 8 aa, Artificial Sequence
  synthetic polypeptide
QQSYDTPL

SEQ ID NO: 6521 - protein, 8 aa, Artificial Sequence
  synthetic polypeptide
QQSYSSPL

SEQ ID NO: 6522 - protein, 8 aa, Artificial Sequence
  synthetic polypeptide
QQSYSTPL

SEQ ID NO: 6523 - protein, 8 aa, Artificial Sequence
  synthetic polypeptide
QQSYDSPL

SEQ ID NO: 6524 - protein, 8 aa, Artificial Sequence
  synthetic polypeptide
QQSYSTPL

SEQ ID NO: 6525 - protein, 8 aa, Artificial Sequence
  synthetic polypeptide
QQSYDNPL

SEQ ID NO: 6526 - protein, 8 aa, Artificial Sequence
  synthetic polypeptide
QQSYSTPL

SEQ ID NO: 6527 - protein, 8 aa, Artificial Sequence
  synthetic polypeptide
QQSYSTPL

SEQ ID NO: 6528 - protein, 8 aa, Artificial Sequence
  synthetic polypeptide
QQSDNTPL

SEQ ID NO: 6529 - protein, 8 aa, Artificial Sequence
  synthetic polypeptide
QQSYELPL

SEQ ID NO: 6530 - protein, 8 aa, Artificial Sequence
  synthetic polypeptide
QQSYSTPL

SEQ ID NO: 6531 - protein, 8 aa, Artificial Sequence
  synthetic polypeptide
QQSYETPL

SEQ ID NO: 6532 - protein, 8 aa, Artificial Sequence
  synthetic polypeptide
QQSYESPL

SEQ ID NO: 6533 - protein, 8 aa, Artificial Sequence
  synthetic polypeptide
QQSYNSPL

SEQ ID NO: 6534 - protein, 8 aa, Artificial Sequence
  synthetic polypeptide
QQSYESPL

SEQ ID NO: 6535 - protein, 8 aa, Artificial Sequence
  synthetic polypeptide
QQSYSTPL

SEQ ID NO: 6536 - protein, 8 aa, Artificial Sequence
  synthetic polypeptide
QQSYDLPL

SEQ ID NO: 6537 - protein, 8 aa, Artificial Sequence
  synthetic polypeptide
QQSYESPL

SEQ ID NO: 6538 - protein, 12 aa, Artificial Sequence
  synthetic polypeptide
  MISC_FEATURE (10)..(10): Xaa at position 10 may be any amino acid
ARSATWHDTXLD

SEQ ID NO: 6539 - protein, 12 aa, Artificial Sequence
  synthetic polypeptide
  MISC_FEATURE (10)..(10): Xaa at position 10 may be Ala or His
ARAANWHDTXLD

SEQ ID NO: 6540 - protein, 12 aa, Artificial Sequence
  synthetic polypeptide
  MISC_FEATURE (10)..(10): Xaa at position 10 may be any amino acid
ARAATWHDTXLD

SEQ ID NO: 6541 - protein, 12 aa, Artificial Sequence
  synthetic polypeptide
  MISC_FEATURE (10)..(10): Xaa at position 10 may be His or Ala.
ARAATWHDTXLD

SEQ ID NO: 6542 - protein, 12 aa, Artificial Sequence
  synthetic polypeptide
  MISC_FEATURE (10)..(10): Xaa at position 10 can be any amino acid.
ARGANWHDTXLD

SEQ ID NO: 6543 - protein, 12 aa, Artificial Sequence
  synthetic polypeptide
  MISC_FEATURE (10)..(10): Xaa at position 10 may be Ala or His
ARGANWHDTXLD

SEQ ID NO: 6544 - protein, 12 aa, Artificial Sequence
  synthetic polypeptide
  MISC_FEATURE (10)..(10): Xaa at position 10 may be any amino acid.
ARGATWHDTXLD

SEQ ID NO: 6545 - protein, 12 aa, Artificial Sequence
  synthetic polypeptide
  MISC_FEATURE (10)..(10): Xaa at position 10 may be Ala or His
ARGATWHDTXLD

SEQ ID NO: 6546 - protein, 12 aa, Artificial Sequence
  synthetic polypeptide
  MISC_FEATURE (10)..(10): Xaa at position 10 may be any amino acid.
ARSANWHDTXLD

SEQ ID NO: 6547 - protein, 12 aa, Artificial Sequence
  synthetic polypeptide
  MISC_FEATURE (2)..(2): Xaa at position 2 may be Arg or Lys.
  MISC_FEATURE (10)..(10): Xaa at position 10 may be Ala or His.
AXSANWHDTXLD

SEQ ID NO: 6548 - protein, 12 aa, Artificial Sequence
  synthetic polypeptide
  MISC_FEATURE (10)..(10): Xaa at position 10 can be any amino acid
ARSATWHDTXLD

SEQ ID NO: 6549 - protein, 12 aa, Artificial Sequence
  synthetic polypeptide
  MISC_FEATURE (10)..(10): Xaa at position 10 may be His or Ala.
ARSATWHDTXLD

SEQ ID NO: 6550 - protein, 6 aa, Artificial Sequence
  synthetic polypeptide
  MISC_FEATURE (1)..(1): Xaa at position 1 may be Asp or Ser.
  MISC_FEATURE (2)..(2): Xaa at position 2 may be Ser or Asp
  MISC_FEATURE (4)..(4): Xaa at position 4 may be Gly or Ser.
  MISC_FEATURE (6)..(6): Xaa at position 6 may be His or Asn.
XXYXMX

SEQ ID NO: 6551 - protein, 13 aa, Artificial Sequence
  synthetic polypeptide
  MISC_FEATURE (3)..(3): Xaa at position 3 is Ala or Ser.
  MISC_FEATURE (4)..(4): Xaa at position 4 is Ser or Gly or Asn
  MISC_FEATURE (9)..(9): Xaa at position 9 is GLy or Ser.
  MISC_FEATURE (12)..(12): Xaa at position 12 is Thr or Lys.
  MISC_FEATURE (13)..(13): Xaa at position 13 is Ser or Gly.
WVXXINYNXGYXX

SEQ ID NO: 6552 - protein, 12 aa, Artificial Sequence
  synthetic polypeptide
  MISC_FEATURE (10)..(10): Xaa at position 10 is Ala or His.
ARAANWHDTXLD

SEQ ID NO: 6553 - protein, 7 aa, Artificial Sequence
  synthetic polypeptide
  MISC_FEATURE (1)..(1): Xaa at position 1 may be any amino acid.
  MISC_FEATURE (2)..(2): Xaa at position 2 may be any amino acid.
  MISC_FEATURE (4)..(4): Xaa at position 4 may be Leu or Val.
XXYXNWY

SEQ ID NO: 6554 - protein, 7 aa, Artificial Sequence
  synthetic polypeptide
  MISC_FEATURE (1)..(1): Xaa at position 1 is Leu or Val or Ile or Ser.
  MISC_FEATURE (2)..(2): Xaa at position 2 is Ser or Thr or Arg.
  MISC_FEATURE (4)..(4): Xaa at position 4 is Leu or Val.
XXYXNWY

SEQ ID NO: 6555 - protein, 10 aa, Artificial Sequence
  synthetic polypeptide
  MISC_FEATURE (2)..(2): Xaa at position 2 is Val or Leu.
  MISC_FEATURE (5)..(5): Xaa at position 5 may be any amino acid.
  MISC_FEATURE (6)..(6): Xaa at position 6 may be any amino acid.
  MISC_FEATURE (7)..(7): Xaa at position 7 may be any amino acid.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be any amino acid.
LXIYXXXXXX

SEQ ID NO: 6556 - protein, 10 aa, Artificial Sequence
  synthetic polypeptide
  MISC_FEATURE (2)..(2): Xaa at position 2 may be Val or Leu.
  MISC_FEATURE (5)..(5): Xaa at position 5 may be Ala, Tyr, or Val.
  MISC_FEATURE (6)..(6): Xaa at position 6 may be Ala, Val, or Thr
  MISC_FEATURE (7)..(7): Xaa at position 7 may be Thr or Ser or Asn.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be Ala, HIs, Gln, or Pro.
LXIYXXXXXX

SEQ ID NO: 6557 - protein, 8 aa, Artificial Sequence
  synthetic polypeptide
  MISC_FEATURE (2)..(2): Xaa at position 2 may be Gln or His.
  MISC_FEATURE (4)..(4): Xaa at position 4 may be Tyr or Asp.
  MISC_FEATURE (5)..(5): Xaa at position 5 may be any amino acid.
  MISC_FEATURE (6)..(6): Xaa at position 6 may be any amino acid.
QXSXXXPL

SEQ ID NO: 6558 - protein, 8 aa, Artificial Sequence
  synthetic polypeptide
  MISC_FEATURE (2)..(2): Xaa at position 2 may be Gln or His.
  MISC_FEATURE (4)..(4): Xaa at position 4 may be Tyr or Asp.
  MISC_FEATURE (5)..(5): Xaa at position 5 may be Asp or Glu or Ser or Asn.
  MISC_FEATURE (6)..(6): Xaa at position 6 may be Leu or Asn or Ser or Thr.
QXSXXXPL

SEQ ID NO: 6559 - protein, 12 aa, Artificial Sequence
  synthetic polypeptide
  MISC_FEATURE (10)..(10): Xaa at position 10 may be His or Ala.
ARAATWHDTXLD

SEQ ID NO: 6560 - protein, 7 aa, Artificial Sequence
  synthetic polypeptide
  MISC_FEATURE (1)..(1): Xaa at position 1 may be any amino acid.
  MISC_FEATURE (2)..(2): Xaa at position 2 may be Ser or Thr.
  MISC_FEATURE (4)..(4): Xaa at position 4 may be Leu or Val.
XXYXNWY

SEQ ID NO: 6561 - protein, 7 aa, Artificial Sequence
  synthetic polypeptide
  MISC_FEATURE (1)..(1): Xaa at position 1 is Leu or Val or Ile or Ser.
  MISC_FEATURE (2)..(2): Xaa at position 2 is Ser or Thr.
  MISC_FEATURE (4)..(4): Xaa at position 4 is Leu or Val.
XXYXNWY

SEQ ID NO: 6562 - protein, 10 aa, Artificial Sequence
  synthetic polypeptide
  MISC_FEATURE (2)..(2): Xaa at position 2 is Leu or Val.
  MISC_FEATURE (5)..(5): Xaa at position 5 is Ala or Tyr.
  MISC_FEATURE (6)..(6): Xaa at position 6 can be any amino acid.
  MISC_FEATURE (7)..(7): Xaa at position 7 may be any amino acid.
  MISC_FEATURE (8)..(8): Xaa at position 8 may be Ser or Asn.
  MISC_FEATURE (9)..(9): Xaa at position 9 can be Arg or Leu.
  misc_feature (10)..(10): Xaa can be any naturally occurring amino acid
LXIYXXXXXX

SEQ ID NO: 6563 - protein, 10 aa, Artificial Sequence
  synthetic polypeptide
  MISC_FEATURE (2)..(2): Xaa at position 2 is Leu or Val.
  MISC_FEATURE (5)..(5): Xaa at position 5 is Ala or Tyr.
  MISC_FEATURE (6)..(6): Xaa at position 6 is Ala, Thr, or Val.
  MISC_FEATURE (7)..(7): Xaa at position 7 is Thr or Ser or Asn.
  MISC_FEATURE (8)..(8): Xaa at position 8 is Ser or Asn.
  MISC_FEATURE (9)..(9): Xaa at position 9 is Arg or Leu.
  MISC_FEATURE (10)..(10): Xaa at position 10 is Ala, Pro, or Gln.
LXIYXXXXXX

SEQ ID NO: 6564 - protein, 8 aa, Artificial Sequence
  synthetic polypeptide
  MISC_FEATURE (4)..(4): Xaa at position 4 is Tyr, Asp, or Asn
  MISC_FEATURE (5)..(5): Xaa at position 5 can be any amino acid.
  MISC_FEATURE (6)..(6): Xaa at position 6 can be any amino acid.
QQSXXXPL

SEQ ID NO: 6565 - protein, 8 aa, Artificial Sequence
  synthetic polypeptide
  MISC_FEATURE (4)..(4): Xaa at position 4 is Tyr or Asp or Asn.
  MISC_FEATURE (5)..(5): Xaa at position 5 is Asp or Glu or Ser or Asn.
  MISC_FEATURE (6)..(6): Xaa at position 6 is Leu or Ser or Thr or Asn.
QQSXXXPL

SEQ ID NO: 6566 - protein, 6 aa, Artificial Sequence
  synthetic polypeptide
  MISC_FEATURE (1)..(1): Xaa at position 1 is Ser or Asp.
  MISC_FEATURE (2)..(2): Xaa at position 2 is Ser or Asp.
  MISC_FEATURE (4)..(4): Xaa at position 4 is Ser or Gly.
  MISC_FEATURE (6)..(6): Xaa at position 6 is Asn or His.
XXYXMX

SEQ ID NO: 6567 - protein, 13 aa, Artificial Sequence
  synthetic polypeptide
  MISC_FEATURE (3)..(3): Xaa at position 3 may be Ser or Ala.
  MISC_FEATURE (4)..(4): Xaa at position 4 may be Gly or Ser or Asn.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6568 - protein, 7 aa, Artificial Sequence
  synthetic polypeptide
  MISC_FEATURE (1)..(1): Xaa at position 1 may be any amino acid.
  MISC_FEATURE (2)..(2): Xaa at positoin 2 may be Ser or Thr.
  MISC_FEATURE (4)..(4): Xaa at position 4 may be Leu or Val.
XXYXNWY

SEQ ID NO: 6569 - protein, 7 aa, Artificial Sequence
  synthetic polypeptide
  MISC_FEATURE (1)..(1): Xaa at position 1 is Leu or Val or Ser or Ile.
  MISC_FEATURE (2)..(2): Xaa at position 2 is Ser or Thr.
  MISC_FEATURE (4)..(4): Xaa at position 4 may be Leu or Val.
XXYXNWY

SEQ ID NO: 6570 - protein, 10 aa, Artificial Sequence
  synthetic polypeptide
  MISC_FEATURE (2)..(2): Xaa at position 2 may be Leu or Val.
  MISC_FEATURE (6)..(6): Xaa at position 6 may be any amino acid.
  MISC_FEATURE (7)..(7): Xaa at position 7 may be Thr or Ser.
  misc_feature (9)..(9): Xaa can be any naturally occurring amino acid
  MISC_FEATURE (10)..(10): Xaa at position 10 may be any amino acid.
LXIYAXXSXX

SEQ ID NO: 6571 - protein, 10 aa, Artificial Sequence
  synthetic polypeptide
  MISC_FEATURE (2)..(2): Xaa at position 2 may be Leu or Val.
  MISC_FEATURE (6)..(6): Xaa at position 6 may be Ala or Val or Thr.
  MISC_FEATURE (7)..(7): Xaa at position 7 may be Thr or Ser.
  MISC_FEATURE (9)..(9): Xaa at position 9 may be Arg or Leu.
  MISC_FEATURE (10)..(10): Xaa at position 10 may be Ala or His or Gln.
LXIYAXXSXX

SEQ ID NO: 6572 - protein, 8 aa, Artificial Sequence
  synthetic polypeptide
  MISC_FEATURE (4)..(4): Xaa at position 4 may be Gly or Asp.
  MISC_FEATURE (5)..(5): Xaa at position 5 may be any amino acid.
  MISC_FEATURE (6)..(6): Xaa at position 6 may be any amino acid.
QQSXXXPL

SEQ ID NO: 6573 - protein, 8 aa, Artificial Sequence
  synthetic polypeptide
  MISC_FEATURE (4)..(4): Xaa at position 4 may be Tyr or Asp.
  MISC_FEATURE (5)..(5): Xaa at position 5 may be Asp or Glu or Ser or Asn
  MISC_FEATURE (6)..(6): Xaa at position 6 may be Ser or Thr or Asn or Leu.
QQSXXXPL

SEQ ID NO: 6574 - protein, 6 aa, Artificial Sequence
  synthetic polypeptide
  MISC_FEATURE (1)..(1): Xaa at position 1 may be Ser or Asp.
  MISC_FEATURE (2)..(2): Xaa at position 2 may be Ser or Asp.
  MISC_FEATURE (4)..(4): Xaa at position 4 may be Ser or Gly.
  MISC_FEATURE (6)..(6): Xaa at position 6 may be Asn or His.
XXYXMX

SEQ ID NO: 6575 - protein, 13 aa, Artificial Sequence
  synthetic polypeptide
  MISC_FEATURE (3)..(3): Xaa at position 3 may be Ala or Ser.
  MISC_FEATURE (4)..(4): Xaa at position 4 may be Gly or Asn or Ser.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6576 - protein, 7 aa, Artificial Sequence
  synthetic polypeptide
  MISC_FEATURE (1)..(1): Xaa at position 1 may be Leu or Ile or Val or Ser.
  MISC_FEATURE (2)..(2): Xaa at position 2 may be Ser or Thr.
  MISC_FEATURE (4)..(4): Xaa at position 4 may be Leu or Val.
XXYXNWY

SEQ ID NO: 6577 - protein, 8 aa, Artificial Sequence
  synthetic polypeptide
  MISC_FEATURE (4)..(4): Xaa at position 4 may be Tyr or Asp.
  MISC_FEATURE (5)..(5): Xaa at position 5 may be Asp or Glu or Ser or Asn.
  MISC_FEATURE (6)..(6): Xaa at position 6 may be Thr or Ser or Asn or Leu.
QQSXXXPL

SEQ ID NO: 6578 - protein, 6 aa, Artificial Sequence
  synthetic polypeptide
  MISC_FEATURE (1)..(1): Xaa at position 1 may be Ser or Asp.
  MISC_FEATURE (2)..(2): Xaa at position 2 may be Ser or Asp.
  MISC_FEATURE (4)..(4): Xaa at position 4 may be Gly or Ser.
  MISC_FEATURE (6)..(6): Xaa at position 6 may be Asn or His.
XXYXMX

SEQ ID NO: 6579 - protein, 13 aa, Artificial Sequence
  synthetic polypeptide
  MISC_FEATURE (3)..(3): Xaa at position 3 may be Ser or Ala.
  MISC_FEATURE (4)..(4): Xaa at position 4 may be Gly or Asn or Ser.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6580 - protein, 12 aa, Artificial Sequence
  synthetic polypeptide
  MISC_FEATURE (2)..(2): Xaa at position 2 may be Arg or Lys.
  MISC_FEATURE (10)..(10): Xaa at position 10 may be Ala or His.
AXSANWHDTXLD

SEQ ID NO: 6581 - protein, 10 aa, Artificial Sequence
  synthetic polypeptide
  MISC_FEATURE (2)..(2): Xaa at position 2 may be Leu or Val.
  MISC_FEATURE (5)..(5): Xaa at position 5 may be Ala or Tyr.
  misc_feature (6)..(6): Xaa can be any naturally occurring amino acid
  MISC_FEATURE (7)..(7): Xaa at position 7 may be Thr or Ser.
  MISC_FEATURE (8)..(8): Xaa at position 8 may be Ser or Asn.
  MISC_FEATURE (9)..(9): Xaa at position 8 may be Arg or Leu.
  MISC_FEATURE (10)..(10): Xaa at position 10 may be any amino acid.
LXIYXXXXXX

SEQ ID NO: 6582 - protein, 10 aa, Artificial Sequence
  synthetic polypeptide
  MISC_FEATURE (2)..(2): Xaa at position 2 may be Leu or Val.
  MISC_FEATURE (5)..(5): Xaa at position 5 may be Ala or Tyr.
  MISC_FEATURE (6)..(6): Xaa at position 6 Ala or Val or Thr.
  MISC_FEATURE (7)..(7): Xaa at position 7 may be Thr or Ser.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be Ala or His or Gln.
LXIYXXXXXX

SEQ ID NO: 6583 - protein, 8 aa, Artificial Sequence
  synthetic polypeptide
  MISC_FEATURE (4)..(4): Xaa at position 4 may be Tyr or Asp.
  MISC_FEATURE (5)..(5): Xaa at position 5 may be Asp or Glu or Asn or Ser.
  MISC_FEATURE (6)..(6): Xaa at position 6 may be Ser or Thr or Leu or Asn.
QQSXXXPL

SEQ ID NO: 6584 - protein, 6 aa, Artificial Sequence
  synthetic polypeptide
  MISC_FEATURE (1)..(1): Xaa at position 1 may be Asp or Ser.
  MISC_FEATURE (2)..(2): Xaa at position 2 may be Ser or Asp.
  MISC_FEATURE (4)..(4): Xaa at position 4 may be Ser or Gly.
  MISC_FEATURE (6)..(6): Xaa at position 6 may be Asn or His.
XXYXMX

SEQ ID NO: 6585 - protein, 13 aa, Artificial Sequence
  synthetic polypeptide
  MISC_FEATURE (3)..(3): Xaa at position 3 may be Ala or Ser.
  MISC_FEATURE (4)..(4): Xaa at position 4 may be Gly or Asn or Ser.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6586 - protein, 12 aa, Artificial Sequence
  synthetic polypeptide
  MISC_FEATURE (10)..(10): Xaa at position 10 may be His or Ala.
ARSATWHDTXLD

SEQ ID NO: 6587 - protein, 7 aa, Artificial Sequence
  synthetic polypeptide
  MISC_FEATURE (1)..(1): Xaa at position 1 may be any amino acid.
  MISC_FEATURE (2)..(2): Xaa at position 2 may be any amino acid.
  MISC_FEATURE (4)..(4): Xaa at position 4 may be Leu or Val.
XXYXNWY

SEQ ID NO: 6588 - protein, 7 aa, Artificial Sequence
  synthetic polypeptide
  MISC_FEATURE (1)..(1): Xaa at position 1 may be Leu or Val or Ile or Ser.
  MISC_FEATURE (2)..(2): Xaa at position 2 may be Ser or Thr or Arg.
  MISC_FEATURE (4)..(4): Xaa at position 4 may be Leu or Val.
XXYXNWY

SEQ ID NO: 6589 - protein, 10 aa, Artificial Sequence
  synthetic polypeptide
  MISC_FEATURE (2)..(2): Xaa at position 2 may be Leu or Val.
  MISC_FEATURE (5)..(5): Xaa at position 5 may be Ala or Tyr.
  MISC_FEATURE (6)..(6): Xaa at position 6 may be any amino acid.
  MISC_FEATURE (7)..(7): Xaa at position 7 may be Thr or Ser.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be any amino acid.
LXIYXXXXXX

SEQ ID NO: 6590 - protein, 10 aa, Artificial Sequence
  synthetic polypeptide
  MISC_FEATURE (2)..(2): Xaa at position 2 may be Leu or Val.
  MISC_FEATURE (5)..(5): Xaa at position 5 may be Ala or Tyr.
  MISC_FEATURE (6)..(6): Xaa at position 6 may be Ala or Val or Thr.
  MISC_FEATURE (7)..(7): Xaa at position 7 may be Thr or Ser.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be Ala or His or Gln.
LXIYXXXXXX

SEQ ID NO: 6591 - protein, 8 aa, Artificial Sequence
  synthetic polypeptide
  MISC_FEATURE (4)..(4): Xaa at position 4 may be Tyr or Asp.
  MISC_FEATURE (5)..(5): Xaa at position 5 may be Asp or Glu or Ser or Asn.
  MISC_FEATURE (6)..(6): Xaa at position 6 may be Leu or Asn or Thr or Ser.
QQSXXXPL

SEQ ID NO: 6592 - protein, 10 aa, Artificial Sequence
  synthetic polypeptide
  MISC_FEATURE (2)..(2): Xaa at position 2 may be Val or Leu.
  MISC_FEATURE (5)..(5): Xaa at position 5 may be Ala or Tyr or Val.
  MISC_FEATURE (6)..(6): Xaa at position 6 may be Ala or Val or Thr.
  MISC_FEATURE (7)..(7): Xaa at position 7 may be Thr or Ser or Asn.
  MISC_FEATURE (8)..(8): Xaa at position 8 may be Ser or Asn.
  MISC_FEATURE (9)..(9): Xaa at position 9 may be Arg or Leu.
  MISC_FEATURE (10)..(10): Xaa at position 10 may be Ala or His or Gln or Pro.
LXIYXXXXXX

SEQ ID NO: 6593 - protein, 8 aa, Artificial Sequence
  synthetic polypeptide
  MISC_FEATURE (2)..(2): Xaa at position 2 may be Gln or His.
  MISC_FEATURE (4)..(4): Xaa at position 4 may be Tyr or Asp.
  MISC_FEATURE (5)..(5): Xaa at position 5 may be Asp or Glu or Ser or Asn.
  MISC_FEATURE (6)..(6): Xaa at position 6 may be Leu or Asn or Ser or Thr.
QXSXXXPL

SEQ ID NO: 6594 - protein, 13 aa, Artificial Sequence
  synthetic polypeptide
  MISC_FEATURE (3)..(3): Xaa at position 3 may be Ser or Ala.
  MISC_FEATURE (4)..(4): Xaa at position 4 may be Gly or Ser or Asn.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6595 - protein, 12 aa, Artificial Sequence
  synthetic polypeptide
  MISC_FEATURE (10)..(10): Xaa at position 10 may be His or Ala.
ARGATWHDTXLD

SEQ ID NO: 6596 - protein, 7 aa, Artificial Sequence
  synthetic polypeptide
  MISC_FEATURE (1)..(1): Xaa at position 1 may be Leu or Ile or Val or Ser.
  MISC_FEATURE (2)..(2): Xaa at position 2 may be Ser or Thr.
  MISC_FEATURE (4)..(4): Xaa at position 4 may be Leu or Val.
XXYXNWY

SEQ ID NO: 6597 - protein, 12 aa, Artificial Sequence
  synthetic polypeptide
  MISC_FEATURE (2)..(2): Xaa at position 2 may be Arg or Lys.
  MISC_FEATURE (10)..(10): Xaa at position 10 may be Ala or His.
AXSANWHDTXLD

SEQ ID NO: 6598 - protein, 8 aa, Artificial Sequence
  synthetic polypeptide
  MISC_FEATURE (4)..(4): Xaa at position 4 may be Tyr or Asp.
  MISC_FEATURE (5)..(5): Xaa at position 5 may be Asp or Glu or Asn or Ser.
  MISC_FEATURE (6)..(6): Xaa at position 6 may be Ser or Thr or Leu or Asn.
QQSXXXPL

SEQ ID NO: 6599 - protein, 5 aa, Artificial Sequence
  synthetic polypeptide
  MISC_FEATURE (1)..(5): The amino acids at position 1 to 5 may be repeated n times.
GSGGS

SEQ ID NO: 6600 - protein, 4 aa, Artificial Sequence
  synthetic polypeptide
  MISC_FEATURE (4)..(4): Amino acids at positions 1 to 4 may be repeated n times.
GGGS

SEQ ID NO: 6601 - protein, 4 aa, Artificial Sequence
  synthetic polypeptide
GGSG

SEQ ID NO: 6602 - protein, 5 aa, Artificial Sequence
  synthetic polypeptide
GGSGG

SEQ ID NO: 6603 - protein, 5 aa, Artificial Sequence
  synthetic polypeptide
GSGSG

SEQ ID NO: 6604 - protein, 5 aa, Artificial Sequence
  synthetic polypeptide
GSGGG

SEQ ID NO: 6605 - protein, 5 aa, Artificial Sequence
  synthetic polypeptide
GGGSG

SEQ ID NO: 6606 - protein, 5 aa, Artificial Sequence
  synthetic polypeptide
GSSSG

SEQ ID NO: 6607 - protein, 10 aa, Artificial Sequence
  synthetic polypeptide
CYPYDVPDYA

SEQ ID NO: 6608 - protein, 8 aa, Artificial Sequence
  synthetic polypeptide
DYKDDDDK

SEQ ID NO: 6609 - protein, 11 aa, Artificial Sequence
  synthetic polypeptide
CEQKLISEEDL

SEQ ID NO: 6610 - protein, 5 aa, Artificial Sequence
  synthetic polypeptide
HHHHH

SEQ ID NO: 6611 - protein, 6 aa, Artificial Sequence
  synthetic polypeptide
HHHHHH

SEQ ID NO: 6612 - protein, 10 aa, Artificial Sequence
  synthetic polypeptide
EQKLISEEDL

SEQ ID NO: 6613 - protein, 8 aa, Artificial Sequence
  synthetic polypeptide
WSHPQFEK

SEQ ID NO: 6614 - protein, 9 aa, Artificial Sequence
  synthetic polypeptide
YPYDVPDYA

SEQ ID NO: 6615 - protein, 5 aa, Artificial Sequence
  synthetic polypeptide
RYIRS

SEQ ID NO: 6616 - protein, 4 aa, Artificial Sequence
  synthetic polypeptide
FHHT

SEQ ID NO: 6617 - protein, 17 aa, Artificial Sequence
  synthetic polypeptide
WEAAAREACCRECCARA

SEQ ID NO: 6618 - protein, 12 aa, Artificial Sequence
  synthetic polypeptide
  MISC_FEATURE (2)..(2): Xaa at position 2 may be any amino acid.
  MISC_FEATURE (3)..(3): Xaa at position 3 may be any amino acid.
  MISC_FEATURE (5)..(5): Xaa at position 5 may be any amino acid.
  MISC_FEATURE (10)..(10): Xaa at position 10 may be any amino acid.
AXXAXWHDTXLD

SEQ ID NO: 6619 - protein, 13 aa, Artificial Sequence
  synthetic polypeptide
  MISC_FEATURE (3)..(3): Xaa at position 3 may be Ala or Ser.
  MISC_FEATURE (4)..(4): Xaa at position 4 may be Ser or Gly or Asn.
  MISC_FEATURE (9)..(9): Xaa at position 9 may be Gly or Ser.
  MISC_FEATURE (12)..(12): Xaa at position 12 may be Thr or Lys.
  MISC_FEATURE (13)..(13): Xaa at position 13 may be Ser or Gly.
WVXXINYNXGYXX

SEQ ID NO: 6620 - protein, 12 aa, Artificial Sequence
  synthetic polypeptide
  MISC_FEATURE (10)..(10): Xaa at position 10 may be Ala or His.
ARAANWHDTXLD

SEQ ID NO: 6621 - protein, 10 aa, Artificial Sequence
  synthetic polypeptide
  MISC_FEATURE (2)..(2): Xaa at position 2 may be Val or Leu.
  MISC_FEATURE (5)..(5): Xaa at position 5 may be Ala or Tyr or Val.
  MISC_FEATURE (6)..(6): Xaa at position 6 may be Ala or Val or Thr.
  MISC_FEATURE (7)..(7): Xaa at position 7 is Thr or Ser or Asn.
  MISC_FEATURE (8)..(8): Xaa at position 8 is Ser or Asn.
  MISC_FEATURE (9)..(9): Xaa at position 9 is Arg or Leu.
  MISC_FEATURE (10)..(10): Xaa at position 10 is Ala or His or Gln or Pro.
LXIYXXXXXX

What is claimed is:

1. An antibody that specifically binds to ACVR2A (Activin Receptor Type IIA), wherein the antibody comprises:
   (a) a variable domain comprising:
      i. a HC CDR(heavy chain complementarity determining region)1 of sequence SSYGMN (SEQ ID NO: 4453), a HC CDR2 of sequence WVAGINYN-GGYTS (SEQ ID NO: 4622), and a HC CDR3 of sequence ARSATWHDTALD (SEQ ID NO: 4791); and
      ii. a LC CDR(light chain complementarity determining region) of sequence LSYLNWY (SEQ ID NO: 4960), a LC CDR2 of sequence LVIYAATSRA (SEQ ID NO: 5129) and a LC CDR3 of sequence QQSYD-SPL (SEQ ID NO: 5298);
   (b) a variable domain comprising:
      i. a HC CDR1 of sequence SSYGMN (SEQ ID NO: 4453), a HC CDR2 of sequence WVAGINYN-GGYTS (SEQ ID NO: 4622), and a HC CDR3 of sequence AxxAxWHDTxLD (SEQ ID NO: 6618), where x is any amino acid;
      ii. a LC CDR of sequence LSYLNWY (SEQ ID NO: 4960), a LC CDR2 of sequence LVIYAATSRA (SEQ ID NO: 5129) and a LC CDR3 of sequence QQSYD-SPL (SEQ ID NO: 5298); or
   (c) a variant of said variable domain of (b) that is otherwise identical to said variable domain of (b) except for up to one amino acid substitution in each of the HC CDR1, HC CDR2, LC CDR1, LC CDR2 and LC CDR3 regions.

2. The antibody of claim 1, wherein the antibody comprises an HC CDR3 of sequence ARSATWHDTH/ALD (SEQ ID NO: 6586), ARAATWHDTxLD (SEQ ID NO: 6540), ARGANWHDTxLD (SEQ ID NO: 6542), ARGAT-WHDTxLD (SEQ ID NO: 6544), ARSANWHDTxLD (SEQ ID NO: 6546) or ARSATWHDTxLD (SEQ ID NO: 6548).

3. The antibody of claim 1, wherein the antibody comprises:
   a HC CDR3 of sequence ARSATWHDTH/ALD (SEQ ID NO: 6586).

4. The antibody of 1, wherein the antibody comprises:
   a heavy chain variable domain comprising an amino acid sequence that is at least 80% identical to SEQ ID NO: 4115; and
   a light chain variable domain comprising an amino acid sequence that is at least 80% identical to SEQ ID NO: 4284.

5. The antibody of claim 1, wherein the heavy chain CDRs and the light chain CDRs are present in separate polypeptides.

6. The antibody of claim 1, wherein the heavy chain CDRs and the light chain CDRs are present in a single polypeptide.

7. The antibody of claim 1, wherein the antibody binds ACVR2A with an affinity in the range of $10^7$ $M^{-1}$ to $10^{12}$ $M^{-1}$.

8. The antibody of claim 1, wherein the antibody comprises a covalently linked non-peptide synthetic polymer.

9. The antibody of claim 8, wherein the synthetic polymer is poly(ethylene glycol) polymer.

10. The antibody of claim 1, wherein the antibody comprises a covalently linked lipid or fatty acid moiety.

11. The antibody of claim 1, wherein the antibody comprises a covalently linked polysaccharide or carbohydrate moiety.

12. The antibody of claim 1, wherein the antibody is a single chain Fv (scFv) antibody.

13. The antibody of claim 12, wherein the scFv is multimerized.

14. A method of treating a condition associated with muscle atrophy, decrease in muscle mass or insufficient lean body mass in a patient comprising administering to the patient an effective amount of the antibody of claim 1.

15. The method according to claim 14, wherein the condition is associated with muscle atrophy.

16. The method according to claim 14, wherein the condition is characterized by a decrease in muscle mass or muscle function, or insufficient lean body mass.

17. The method according to claim 14, wherein the condition is cachexia or sarcopenia.

* * * * *